United States Patent
Cheng et al.

(10) Patent No.: US 11,447,771 B1
(45) Date of Patent: Sep. 20, 2022

(54) CRISPR DNA TARGETING ENZYMES AND SYSTEMS

(71) Applicant: ARBOR BIOTECHNOLOGIES, INC., Cambridge, MA (US)

(72) Inventors: David R. Cheng, Boston, MA (US); David A. Scott, Cambridge, MA (US); Winston X. Yan, Boston, MA (US)

(73) Assignee: ARBOR BIOTECHNOLOGIES, Inc., Cambridge, MA (US)

( * ) Notice: Subject to any disclaimer, the term of this patent is extended or adjusted under 35 U.S.C. 154(b) by 0 days.

(21) Appl. No.: 17/506,627

(22) Filed: Oct. 20, 2021

Related U.S. Application Data

(63) Continuation of application No. 17/260,791, filed as application No. PCT/US2018/068007 on Dec. 28, 2018.

(60) Provisional application No. 62/699,513, filed on Jul. 17, 2018, provisional application No. 62/698,842, filed on Jul. 16, 2018.

(51) Int. Cl.
*C12N 15/11* (2006.01)
*C07K 14/47* (2006.01)

(52) U.S. Cl.
CPC ........ *C12N 15/111* (2013.01); *C07K 14/4702* (2013.01); *C12N 2310/20* (2017.05)

(58) Field of Classification Search
None
See application file for complete search history.

(56) References Cited

FOREIGN PATENT DOCUMENTS

| WO | 2018035250 A1 | 2/2018 |
| WO | 2020018142 A1 | 1/2020 |
| WO | 2021001534 A1 | 1/2021 |

OTHER PUBLICATIONS

International Search Report for International Application No. PCT/US2018/068007 dated Apr. 8, 2019.
International Preliminary Report from International Application No. PCT/US2018/068007 dated Jan. 19, 2021.
Yan et al. "Cas13d is a compact RNA-targeting type VI CRISPR effector positively modulated by a WYL domain-containing accessory protein" Mol Cell (2018) vol. 70, No. 2, pp. 327-339.
Shmakov et al., "Diversity and Evolution of class 2 CRISPR-Cas Systems" Nature Reviews Microbiology (2017) vol. 15, pp. 169-182.

*Primary Examiner* — Robert M Kelly
(74) *Attorney, Agent, or Firm* — K & L Gates, LLP

(57) ABSTRACT

The disclosure describes novel systems, methods, and compositions for the manipulation of nucleic acids in a targeted fashion. The disclosure describes non-naturally occurring, engineered CRISPR-Cas systems, components, and methods for targeted modification of nucleic acids such as DNA. Each system includes one or more protein components and one or more nucleic acid components that together target nucleic acids.

22 Claims, 50 Drawing Sheets
Specification includes a Sequence Listing.

```
GTTTCATCGGCCATCGCGGCGGCC-TCGTAGCTGCGAC
ATCTCAATGGCCATCGTCGGGGCT-TTGTACCGGCGAC
GGTGCTCAAGCCATCGCAGCGGCA-TCGTTGCTGCGAC
GTTGCAATGCCTAGCTCAGAGGTT-TAAAGACTGAGAC
GTTGCAGTGCCCAGCTCAGGGGCT-TGATAACTGAGAC
GTTGCAGTACCCTGCTCACGGGGG-AGACAAGTGAGAG
 GTGTTATGCCCATCTCAGCGGGC-TGGTTGCTGAGAC
GTTTCAGTATCCTGCTCAGAGGAG-TCGTTTCTGAGAC
          AGCCATCGCAGGGGCT-TGGTGCTTGCGAC
GTGGAGAGGCCAGCGCAGGGGCT-TTGTGCCTGCGAC
GTCACAATGCCTGCGCAGAGGCT-TTGTTTCTGCGAC
GTCGCAACGCCTGCGCGGAGGCT-TTGTTTCCGCGAC
GTCACAACGCCTGCGCAAGGGCT-TTGTTATTGCGAC
CGTCGCAACGCCTGCGGAGAGGCC-TTGTTTCTCCGAC
GTCGCAACGCCTGCGGAGAGGCC-TTGTTTCTCCGAC
GTCACAACGCCCGCGCAGGGGCT-TGGTATCTGCGAC
CCGGGAACAGCCGCGCAGGGGCT-TGGTGCCTGCGAC
CCGACAACGCCTGCGCAGGGGCT-TGGTTTCTGCGAC
GTATCAATGCCTGCTCAAGGGCT-TTGTGCTTGAGAC
GGAGCAATGCCTGCACGAGGGCT-TTGTGCTCGTGAC
GGTTGAAGCGCCCGCGCAAGGGCT-TTGTACTTGCGAC
ATCGAAGAGCCTGCTCAGGGGCT-TTGTTCTTGAGAC
GCCGTCGAAATGCCTGCTCGGGGGCT-TCGTACCTGAGAC
GTCGAAATGCCCGCGCGGGGGCG-TCGTACCCGCGAC
GGGTGGCAGTGCCTGCTCAGAGGCT-TAGTATCTGTGAC
TGTGGCAGTGCCTGCTCAGAGGCT-TAGTATCTGTGAC
GTGCAAATGCCCGCACAGAGGCT-TAGTGTCTGTGAC
GTCGAAATGCCCGCTCAGCGGCT-TAGTTGCTGAGAC
CTCACAGTGCCTGCGCAGCGGCT-TCGTAGCTGCGAC
GTTGGAATGCCTGTGGAAAGGCT-TTGTATTTCCAAC
CTTGCAATGGCTGCGCAGGGCCT-TGGACGCTGCGAC
CTCGCAACGCCAGCGCAGGGGCC-ATGACGCTGCGAC
GGTCGAAATGCCTGCGCAGGGGCT-TCAACGCTGCGAC
 AGCAATGCGAGCGCAGACGCT-TCGTATCTGCGAC
GTCGCGAAGCTAGCGCAGAAGCT-TGGTATCTGCGAG
GTAGTAACGCCCGCGAACAGGCT-TCGTTTGTTCGAC
      AACGCCTGCGAACAGGCT-TCGTTTGTTCGAC
GTCGCAACGCCTGCGTCGGGCC-TCGTGCCGACGAC
GTTACAAACCCTGCTCATTGGGT-TGGTTAATGAGAC
GTTGCAATGCCTGCTCATAGGCT-TGGTTTATGAGAC
GTGTCAACGCCAGCGCGGAGGCG-TGAAATCCGAGAC
5'-                                    -[Spacer]-3'
```

FIG. 2A

Query: CLUST.018837 [M=614]
Scores for complete sequences (score includes all domains):

| --- full sequence --- | | | --- best 1 domain --- | | | --- #dom --- | | Sequence | Description |
|---|---|---|---|---|---|---|---|---|---|
| E-value | score | bias | E-value | score | bias | exp | N | | |
| 1.6e-14 | 63.5 | 0.1 | 1.6e-14 | 63.4 | 0.1 | 1.0 | 1 | D4ZT60_ARTPN/6-73 | D4ZT60.1 PF07282.10;OrfB_Zn_ribbon; |
| 1.8e-14 | 63.3 | 0.1 | 1.8e-14 | 63.3 | 0.1 | 1.0 | 1 | B4VPC9_9CYAN/464-532 | B4VPC9.1 PF07282.10;OrfB_Zn_ribbon; |
| 3e-14 | 62.5 | 0.1 | 3.3e-14 | 62.4 | 0.1 | 1.0 | 1 | A0A0J9EV43_9CYAN/10-78 | A0A0J9EV43.1 PF07282.10;OrfB_Zn_ribbon; |
| 5.9e-14 | 61.5 | 0.1 | 6.5e-14 | 61.4 | 0.1 | 1.0 | 1 | F4XIK9_9CYAN/300-368 | F4XIK9.1 PF07282.10;OrfB_Zn_ribbon; |
| 8.9e-14 | 61.0 | 0.3 | 9.9e-14 | 60.8 | 0.3 | 1.0 | 1 | K9X6S0_9NOST/433-501 | K9X6S0.1 PF07282.10;OrfB_Zn_ribbon; |
| 1.9e-13 | 59.8 | 0.2 | 2.2e-13 | 59.7 | 0.2 | 1.0 | 1 | K9W2Q9_9CYAN/284-352 | K9W2Q9.1 PF07282.10;OrfB_Zn_ribbon; |
| 2.7e-13 | 59.4 | 0.0 | 2.7e-13 | 59.3 | 0.0 | 1.0 | 1 | D2RFI2_ARCPA/287-355 | D2RFI2.1 PF07282.10;OrfB_Zn_ribbon; |

FIG. 5A

```
5,590   5,600   5,610   5,620   5,630   5,640   5,650   5,660   5,670   5,680   5,690   5,700   5,710   5,720   5,730
AGCCGTTGGTGATGGTTAGGTTGGGCAACTGCAATCAGTTCTGGATCCGCACTGCAGCCCTTAAAACCAGCTTTCAGCGTGGTTCAGGCCACCGGTTTGCACGTGGTGAAGAAAAAATTCAGGATACCCTGACACTGCAGTTTACC
                                                                    Effector_A 5,740   5,750   5,760   5,770   5,780   5,790   5,800   5,810   5,820   5,830   5,840   5,850   5,860   5,870   5,880
GCAGCCCGGTGGTGGTTCCGGTTCCGAGCTGGTCGTGAGCGGGTGAGCTGACTGCAGGATCGTGAGGATCATTCAGAACTGAGGTGCTCGTAGCAGCTGTAACTTTCGTCGTCTGTGGGTAGCCAAGGCCGCAGATACCTATGCAAGTGGAAATGGCCACCTGCAGT
                                                                    Effector_A 5,890   5,900   5,910   5,920   5,930   5,940   5,950   5,960   5,970   5,980   5,990   6,000   6,010   6,020   6,030   6,040
ATCATCGTCCGCTGCCCGATGGTGCAACTGGTTCGTGGCCACGTCGGTGGAGCTGGCACCGAACCAAGCATCGTCCAGTGAAGCTGGCACGTTCAAGATTTCAATGGGCACTCCGCAGCTGATTGGTTAAACCGTTCGTTAAAACGGGCATGATGCAGTGCAATATCATGGAAGGTCGTAAACCCTGGTTGC
                                                                    Effector_A 6,050   6,060   6,070   6,080   6,090   6,100   6,110   6,120   6,130   6,140   6,150   6,160   6,170   6,180   6,190
CGTTCATTTTGGCTGGTTGGCCTGCGCTGGATCAAGCCGTGTCGTGTTCCGTGTTGTTCAGGTATTAGCGGATATACCGATGTGCAGGTGTTGTTGCCCGGTTCTGACGCTGAGTTGAAGATGATGGTATTCTGTCGTCAAGATTCAAGCAGAGAATTCAGAGCGCACGTGAT
                                                                    Effector_A
```

CRISPR DNA TARGETING ENZYMES AND SYSTEMS

CROSS-REFERENCE TO RELATED APPLICATIONS

This application is a continuation of U.S. Ser. No. 17/260,791, filed Jan. 15, 2021, which is a U.S. National Stage Application under 35 U.S.C. § 371 of International Application No. PCT/US2018/068007, filed Dec. 28, 2018, which claims priority to U.S. Ser. No. 62/698,842, filed Jul. 16, 2018, and U.S. Ser. No. 62/699,513, filed Jul. 17, 2018.

SEQUENCE LISTING

The instant application contains a Sequence Listing which has been submitted electronically in ASCII format and is hereby incorporated by reference in its entirety. Said ASCII copy, created on Mar. 5, 2019, is named 45138-0014WO1_SL.txt and is 1,380,167 bytes in size.

FIELD OF THE INVENTION

The present disclosure relates to novel CRISPR-Cas systems and components, systems for detecting CRISPR-Cas systems, and methods and compositions for use of the CRISPR systems in, for example, nucleic acid targeting and manipulation.

BACKGROUND

Recent application of advances in genome sequencing technologies and analysis have yielded significant insights into the genetic underpinning of biological activities in many diverse areas of nature, ranging from prokaryotic biosynthetic pathways to human pathologies. To fully understand and evaluate the vast quantities of information produced by genetic sequencing technologies, equivalent increases in the scale, efficacy, and ease of technologies for genome and epigenome manipulation are needed. These novel genome and epigenome engineering technologies will accelerate the development of novel applications in numerous areas, including biotechnology, agriculture, and human therapeutics.

Clustered Regularly Interspaced Short Palindromic Repeats (CRISPR) and the CRISPR-associated (Cas) genes, collectively known as the CRISPR-Cas or CRISPR/Cas systems, are currently understood to provide immunity to bacteria and archaea against phage infection. The CRISPR-Cas systems of prokaryotic adaptive immunity are an extremely diverse group of proteins effectors, non-coding elements, as well as loci architectures, some examples of which have been engineered and adapted to produce important biotechnologies.

The components of the system involved in host defense include one or more effector proteins capable of modifying DNA or RNA and an RNA guide element that is responsible to targeting these protein activities to a specific sequence on the phage DNA or RNA. The RNA guide is composed of a CRISPR RNA (crRNA) and may require an additional trans-activating RNA (tracrRNA) to enable targeted nucleic acid manipulation by the effector protein(s). The crRNA consists of a direct repeat responsible for protein binding to the crRNA and a spacer sequence that is complementary to the desired nucleic acid target sequence. CRISPR-Cas systems can be reprogrammed to target alternative DNA or RNA targets by modifying the spacer sequence of the crRNA.

CRISPR-Cas systems can be broadly classified into two classes: Class 1 systems are composed of multiple effector proteins that together form a complex around a crRNA, and Class 2 systems consist of a single effector protein that complexes with the crRNA to target DNA or RNA substrates. The single-subunit effector composition of the Class 2 systems provides a simpler component set for engineering and application translation, and have thus far been an important source of programmable effectors. Thus, the discovery, engineering, and optimization of novel Class 2 systems may lead to widespread and powerful programmable technologies for genome engineering and beyond.

The characterization and engineering of Class 2 CRISPR-Cas systems, exemplified by CRISPR-Cas9, have paved the way for a diverse array of biotechnology applications in genome editing and beyond. For example, the effector proteins Cas12a (Cpf1) and Cas13a (C2c2) possess non-target-specific "collateral" single-stranded-nuclease cleavage activities, which may be harnessed to create novel diagnostics, methods, and other applications. Nevertheless, there remains a need for additional programmable effectors and systems for modifying nucleic acids and polynucleotides (i.e., DNA, RNA, or any hybrid, derivative, or modification) beyond the current CRISPR-Cas systems that enable novel applications through their unique properties.

SUMMARY

The present disclosure provides non-naturally-occurring, engineered systems and compositions for new single-effector Class 2 CRISPR-Cas systems, together with methods for computational identification of new CRISPR-Cas systems from genomic databases, together with the development of the natural loci into engineered systems, and experimental validation and application translation. These new effectors are divergent in sequence to orthologs and homologs of existing Class 2 CRISPR effectors, and also have unique domain organizations. They provide additional features that include, but are not limited to, 1) novel DNA/RNA editing properties and control mechanisms, 2) smaller size for greater versatility in delivery strategies, 3) genotype triggered cellular processes such as cell death, and 4) programmable RNA-guided DNA insertion, excision, and mobilization. Adding the novel DNA-targeting systems described herein to the toolbox of techniques for genome and epigenome manipulation enables broad applications for specific, programmed perturbations.

This disclosure relates to new CRISPR-Cas systems including newly discovered enzymes and other components used to create minimal systems that can be used in non-natural environments, e.g., in bacteria other than those in which the system was initially discovered or in mammalian cells.

In one aspect, the disclosure provides engineered, non-naturally occurring Clustered Regularly Interspaced Short Palindromic Repeat (CRISPR)—Cas systems of CLUST.018837 including an RNA guide comprising a direct repeat sequence and a spacer sequence capable of hybridizing to a target nucleic acid; and a CRISPR-associated protein, wherein the CRISPR-associated protein comprises or consists of an amino acid sequence that is at least 80% (e.g., 81%, 82%, 83%, 84%, 85%, 86%, 87%, 88%, 89%, 90%, 91%, 92%, 93%, 94%, 95%, 96%, 97%, 98%, 99% or 100%) identical to an amino acid sequence provided in Table 2 (e.g., SEQ ID NOs: 1-26, 48-262); wherein the CRISPR-associated protein is capable of binding to the RNA guide and of targeting the target nucleic acid sequence complementary to the spacer sequence. In some embodiments, the CRISPR-associated protein has a RuvC domain.

In some embodiments of any of the systems described herein, the CRISPR associated protein is the CLUST.018837 effector protein NZ_LDOS01000005 (SEQ ID NO: 1), found in *Metallibacterium scheffleri*.

In certain embodiments of any of the systems described herein, the CRISPR associated protein is the CLUST.018837 effector protein 3300009004 (SEQ ID NO: 9).

In some embodiments of any of the systems described herein, the CRISPR associated protein is the CLUST.018837 effector protein APMI01033782 (SEQ ID NO: 26).

In embodiments of any of the systems described herein, the CRISPR associated protein is the CLUST.018837 effector protein NZ_LVXZ01000012 (SEQ ID NO: 3), found in *Acidithiobacillus ferrooxidans*.

In some embodiments of any of the systems described herein, the CRISPR associated protein is the CLUST.018837 effector protein ADIG01000806 (SEQ ID NO: 20).

In various embodiments of any of the systems described herein, the spacer sequence of the RNA guide includes or consists of between about 15 to about 24 nucleotides (e.g., 16 to 22 nucleotides).

In some embodiments of any of the systems described herein, the RNA guide includes a direct repeat sequence comprising or consisting of a nucleotide sequence provided in Table 3 (e.g., SEQ ID NOs: 27-47, 263-440).

In some embodiments of any of the systems provided herein, the target nucleic acid is a DNA. In some embodiments of any of the systems provided herein, the target nucleic acid is a single-stranded DNA. In some embodiments of any of the systems described herein, the target nucleic acid comprises a protospacer adjacent motif (PAM) (e.g., a 5'-TTN-3' PAM or a 5'-YTN-3' PAM, wherein N is any nucleobase and Y is cytosine or thymine).

In certain embodiments of any of the systems provided herein, the targeting of the target nucleic acid by the CRISPR-associated protein and RNA guide results in a modification (e.g., a single-stranded or a double-stranded cleavage event) in the target nucleic acid. In some embodiments, the modification is a deletion event. In some embodiments, the modification is an insertion event. In some embodiments, the modification results in cell toxicity.

In some embodiments, the CRISPR associated protein has non-specific (i.e., "collateral") nuclease (e.g., DNAse) activity. In certain embodiments of any of the systems provided herein, the system further includes a donor template nucleic acid (e.g., a DNA or a RNA).

In certain embodiments of any of the systems provided herein, the system is within a cell (e.g., a eukaryotic cell (e.g., a mammalian cell) or a prokaryotic cell (e.g., a bacterial cell).

In some embodiments of any of the systems provided herein, the RNA guide comprises a tracrRNA, a modulator RNA, or both. In some embodiments of any of the systems provided herein, the system further includes a tracrRNA. In some embodiments of any of the systems provided herein, the system further includes a modulator RNA.

In another aspect, the disclosure provides methods of targeting and editing a target nucleic acid, wherein the methods include contacting the target nucleic acid with any of the systems described herein.

In another aspect, the disclosure provides methods of targeting the insertion of a payload nucleic acid at a site of a target nucleic acid, wherein the methods include contacting the target nucleic acid with any of the systems described herein.

In yet another aspect, the disclosure provides methods of targeting the excision of a payload nucleic acid from a site of a target nucleic acid, wherein the methods include contacting the target nucleic acid with any of the systems described herein.

In some embodiments of any of the methods described herein, the target nucleic acid is present at a transcriptionally-active site.

In another aspect, the disclosure provides methods of non-specifically degrading single-stranded DNA upon recognition of a DNA target nucleic acid, wherein the methods include contacting the target nucleic acid with any of the systems described herein.

In another aspect, the disclosure provides an engineered, non-naturally occurring Clustered Regularly Interspaced Short Palindromic Repeat (CRISPR) Cas system of CLUST.018837 comprising: a CLUST.018837 CRISPR RNA (crRNA) and/or a nucleic acid encoding the crRNA, wherein the crRNA includes or consists of a direct repeat sequence and a spacer sequence capable of hybridizing to a target nucleic acid, wherein the direct repeat sequence comprises 5'-YBVMRAC-3' (wherein Y is C, T, or U; B is T, U, C, or G; V is G, C, or A; M is A or C; and R is A or G) at the 3' terminal end; and a CLUST.018837 CRISPR-Cas effector protein and/or a nucleic acid encoding the effector protein, wherein the effector protein is capable of binding to the crRNA and of targeting the target nucleic acid sequence complementary to the crRNA spacer sequence, wherein the target nucleic acid is a DNA.

The term "cleavage event," as used herein, refers to a DNA break in a target nucleic acid created by a nuclease of a CRISPR-Cas system described herein. In some embodiments, the cleavage event is a double-stranded DNA break. In some embodiments, the cleavage event is a single-stranded DNA break.

The term "CRISPR-Cas system" as used herein refers to nucleic acids and/or proteins involved in the expression of, or directing the activity of, CRISPR-Cas effectors, including sequences encoding CRISPR-Cas effectors, RNA guides, and other sequences and transcripts from a CRISPR locus.

The term "CRISPR array" as used herein refers to the nucleic acid (e.g., DNA) segment that includes CRISPR repeats and spacers, starting with the first nucleotide of the first CRISPR repeat and ending with the last nucleotide of the last (terminal) CRISPR repeat. Typically, each spacer in a CRISPR array is located between two repeats. The term "CRISPR repeat," or "CRISPR direct repeat," or "direct repeat," as used herein, refers to multiple short direct repeating sequences, which show very little or no sequence variation within a CRISPR array.

The term "CRISPR RNA" or "crRNA" as used herein refers to an RNA molecule comprising a guide sequence used by a CRISPR effector to specifically target a nucleic acid sequence. Typically, crRNAs contain a sequence that mediates target recognition and a sequence that forms a duplex with a tracrRNA. The crRNA: tracrRNA duplex binds to a CRISPR effector. The term "donor template nucleic acid," as used herein refers to a nucleic acid molecule that can be used by one or more cellular proteins to alter the structure of a target nucleic acid after a CRISPR enzyme described herein has altered a target nucleic acid. In some embodiments, the donor template nucleic acid is a double-stranded nucleic acid. In some embodiments, the donor template nucleic acid is a single-stranded nucleic acid.

In some embodiments, the donor template nucleic acid is linear. In some embodiments, the donor template nucleic acid is circular (e.g., a plasmid). In some embodiments, the donor template nucleic acid is an exogenous nucleic acid molecule. In some embodiments, the donor template nucleic acid is an endogenous nucleic acid molecule (e.g., a chromosome).

The term "CRISPR-Cas effector," "CRISPR effector," "effector," "CRISPR-associated protein," or "CRISPR enzyme" as used herein refers to a protein that carries out an enzymatic activity or that binds to a target site on a nucleic acid specified by an RNA guide. In some embodiments, a CRISPR effector has endonuclease activity, nickase activity, exonuclease activity, transposase activity, and/or excision activity.

The term "RNA guide" as used herein refers to any RNA molecule that facilitates the targeting of a protein described herein to a target nucleic acid. Exemplary "RNA guides" include, but are not limited to, crRNAs, as well as crRNAs fused to either tracrRNAs and/or modulator RNAs. In some embodiments, an RNA guide includes both a crRNA and a tracrRNA. In some embodiments, an RNA guide includes a crRNA and a modulator RNA. In some embodiments, a RNA guide includes a crRNA, a tracrRNA, and a modulator RNA.

The term "modulator RNA" as described herein refers to any RNA molecule that modulates (e.g., increases or decreases) an activity of a CRISPR-Cas effector or a nucleoprotein complex that includes a CRISPR-Cas effector. In some embodiments, a modulator RNA modulates a nuclease activity of a CRISPR-Cas effector or a nucleoprotein complex that includes a CRISPR-Cas effector.

As used herein, the term "targeting" refers to the ability of a complex including a CRISPR-associated protein and a RNA guide, such as a crRNA, to bind to a specific target nucleic acid and not to other nucleic acids that do not have the same sequence as the target nucleic acid.

As used herein, the term "target nucleic acid" refers to a specific nucleic acid sequence that is to be modified by a CRISPR-Cas system described herein. In some embodiments, the target nucleic acid comprises a gene. In some embodiments, the target nucleic acid comprises a non-coding region (e.g., a promoter). In some embodiments, the target nucleic acid is single-stranded. In some embodiments, the target nucleic acid is double-stranded.

The terms "trans-activating crRNA" or "tracrRNA" as used herein refer to an RNA including a sequence that forms a structure required for a CRISPR effector to bind to a specified target nucleic acid.

A "transcriptionally-active site" as used herein refers to a site in a nucleic acid sequence comprising promoter regions at which transcription is initiated and actively occurring.

The term "collateral RNAse activity," as used herein in reference to a CRISPR enzyme, refers to non-specific RNAse activity of a CRISPR enzyme after the enzyme has modified a specifically targeted nucleic acid.

As used herein, the terms "engineered," "genetically-engineered," "genetically-modified," "recombinant," and "modified," are used interchangeably and indicate intentional human manipulation to create, or cause a change in, a sequence, combination of sequences, or composition such that the sequence, combination of sequences, or composition does not exist in nature.

As used herein the term "operably linked" refers to nucleic acid sequences or amino acid sequences placed into a functional relationship with one another. For instance, a promoter or enhancer is operably linked to a coding sequence if it affects the modulation of the transcription of the coding sequence. Operably linked DNA sequences encoding regulatory sequences are typically contiguous to the coding sequence. However, enhancers can be functional when separated from a promoter, e.g., by up to several kilobases or more. Accordingly, some nucleic acid molecules may be operably linked, but not contiguous.

As used herein, the term "subject," refers to any mammals, including, without limitation, humans and other primates, including rhesus macaques, chimpanzees and other monkey and ape species; farm animals, such as cattle, sheep, pigs, goats, and horses; domestic mammals, such as dogs and cats; laboratory animals, including rabbits, mice, rats, and guinea pigs; as well as birds, including domestic, wild, and game birds, such as chickens, turkeys, ducks, and geese; and the like. The term includes adult, young, and newborn individuals as well as male and female subjects. In some embodiments, a host cell is derived from a subject (e.g., stem cells, progenitor cells, or tissue-specific cells). In some embodiments, the subject is a non-human subject.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

BRIEF FIGURE DESCRIPTION

FIGS. 1A and 1B are a group of schematic sequence representations that together show conserved CLUST.018837 effectors and CRISPR array elements for representative loci.

FIG. 2A is a series of sequences that show the multiple sequence alignment of examples of CRISPR direct repeat elements for CLUST.018837. FIG. 2A discloses SEQ ID NOS 27, 47, 32, 263, 356, 429, 29, 293, 40, 375, 1017, 339, 336, 1018, 332, 317, 329, 1019, 299, 338, 276, 302, 379, 436, 1020-1021, 316, 387, 289, 334, 372, 414, 439, 335, 418, 306, 310, 390, 266, 291 and 1022, respectively, in order of appearance.

FIG. 3A discloses SEQ ID NOS 1023-1034 and FIG. 3B discloses SEQ ID NOS 1035-1043, all respectively, in order of appearance.

FIGS. 4A, 4B, 4C, 4D, 4E, and 4F are schematic representations that together show a phylogenetic tree of CLUST.018837 effector proteins.

FIG. 5A shows PFAM domain mapping results for CLUST.018837 effector proteins.

Figure 5B:
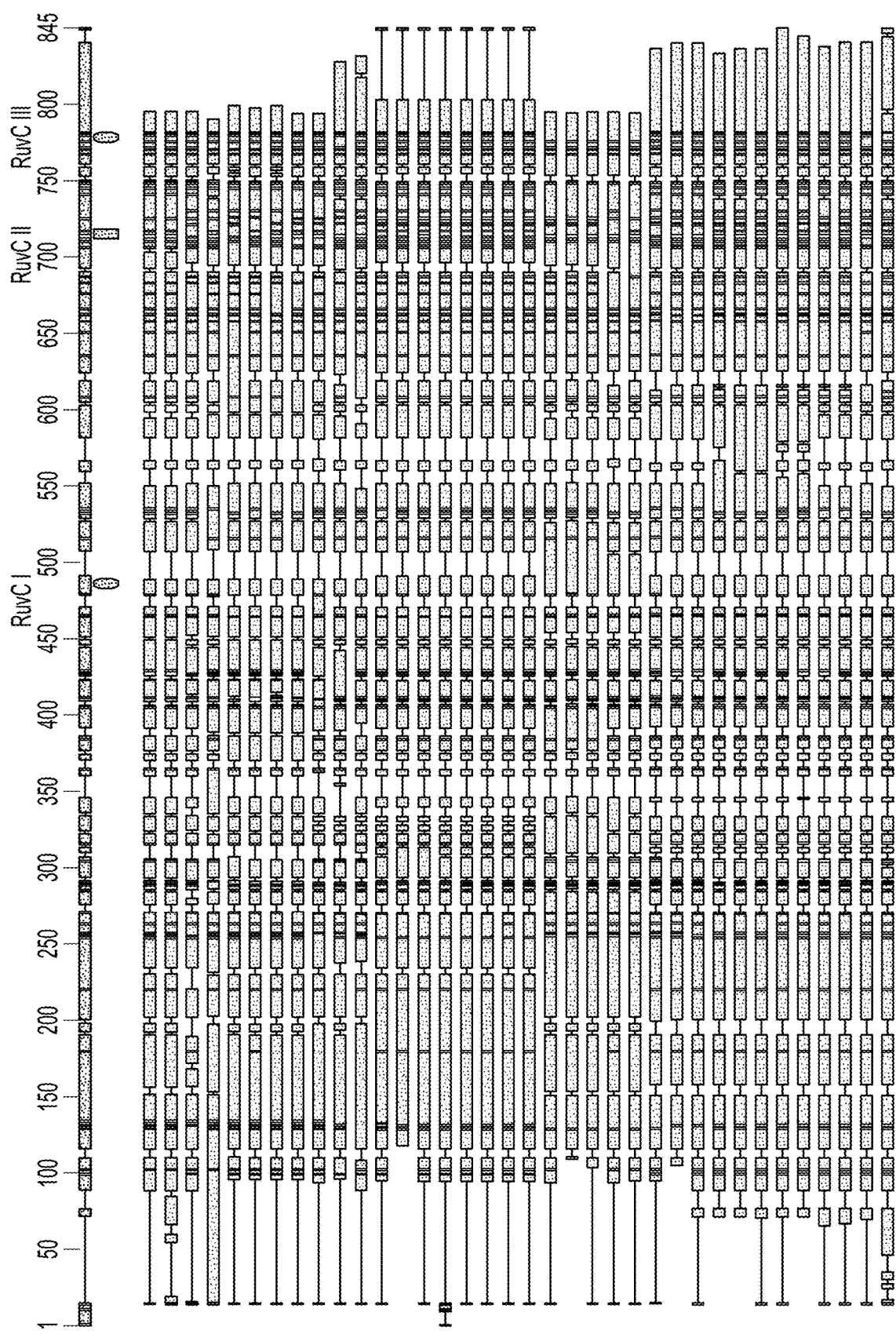
Figure 6A:
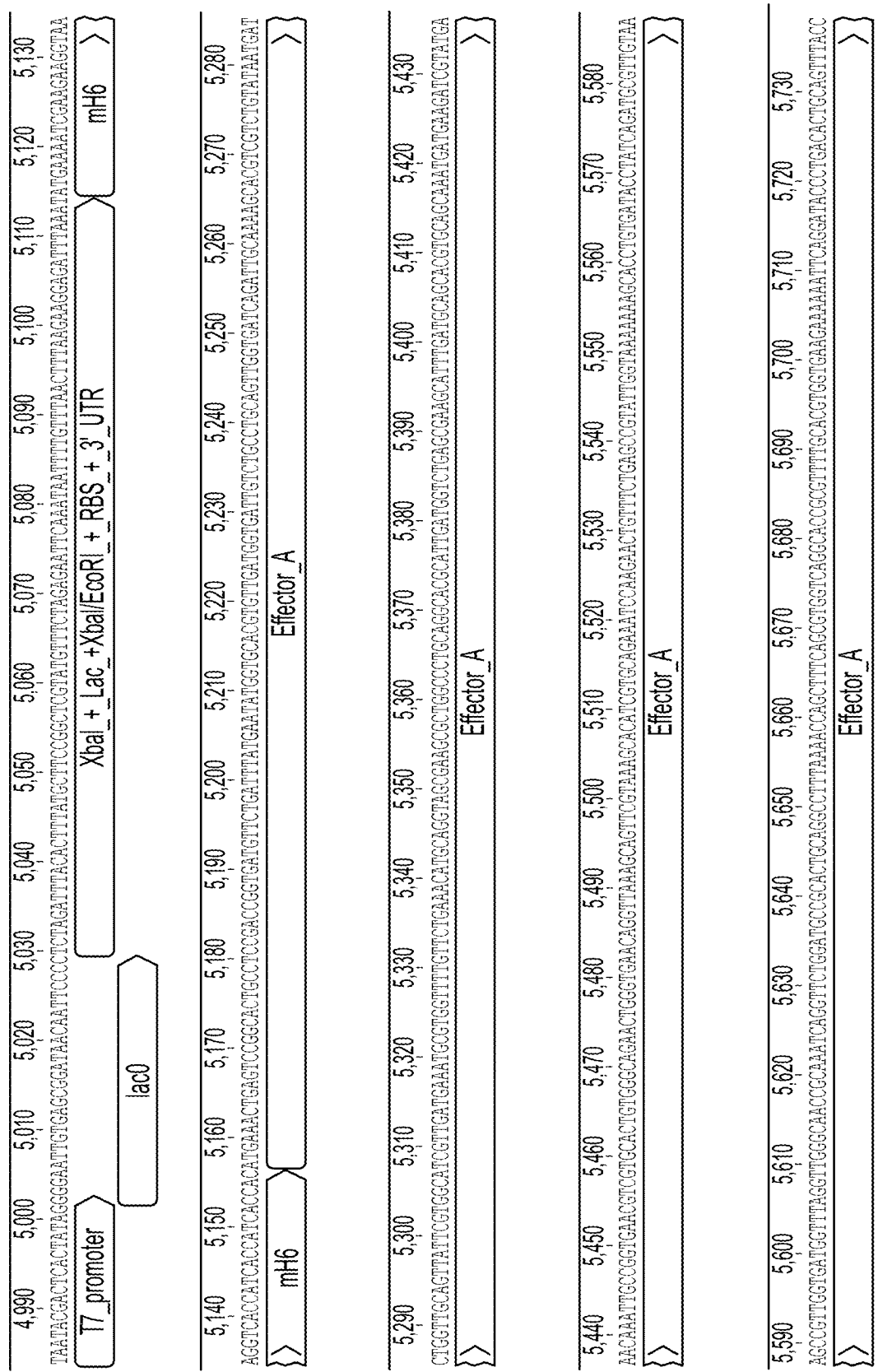
Figure 6D:
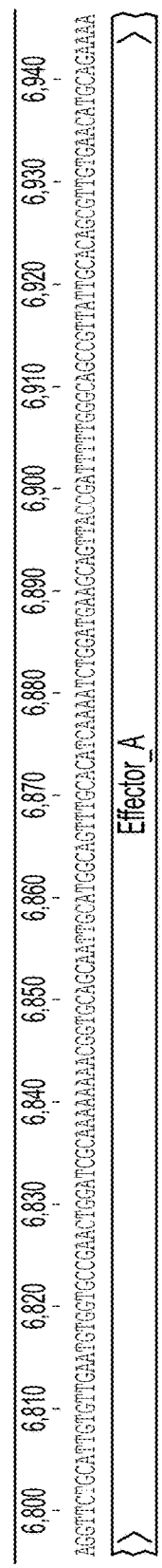
Figure 6D:
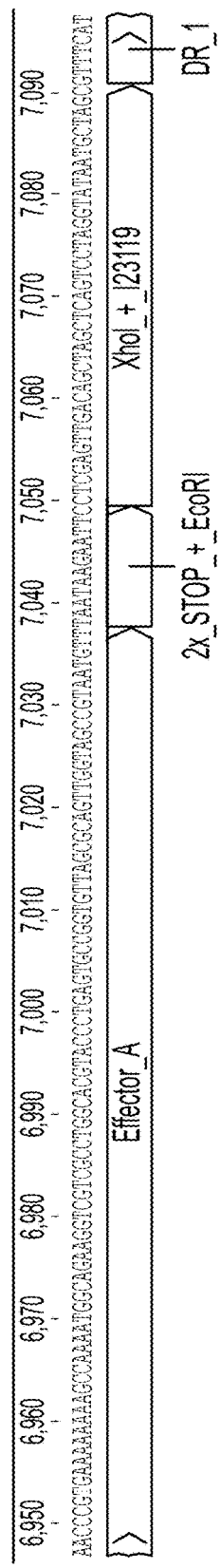
Figure 6D:
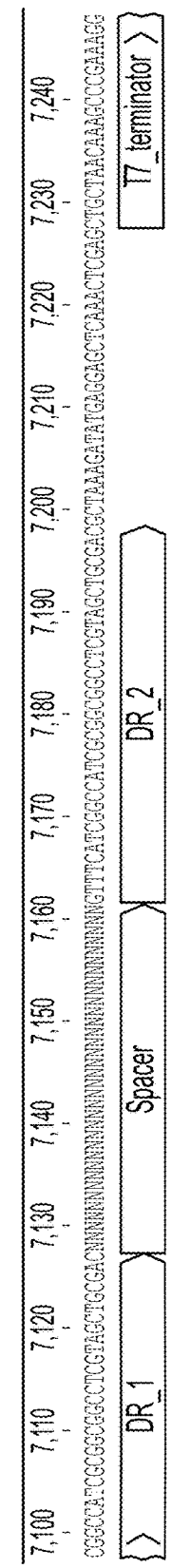
Figure 6D:
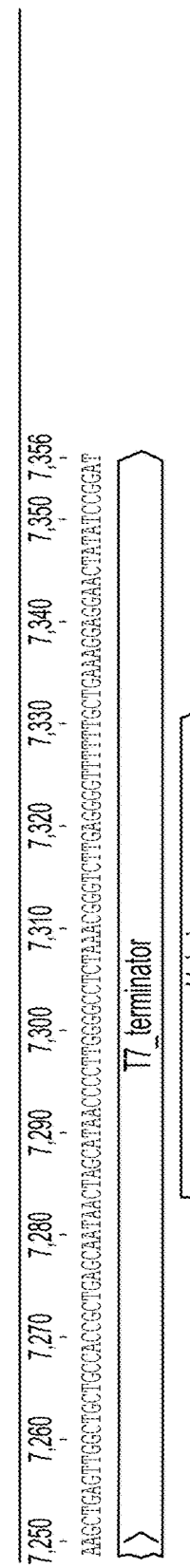
Figure 7A:
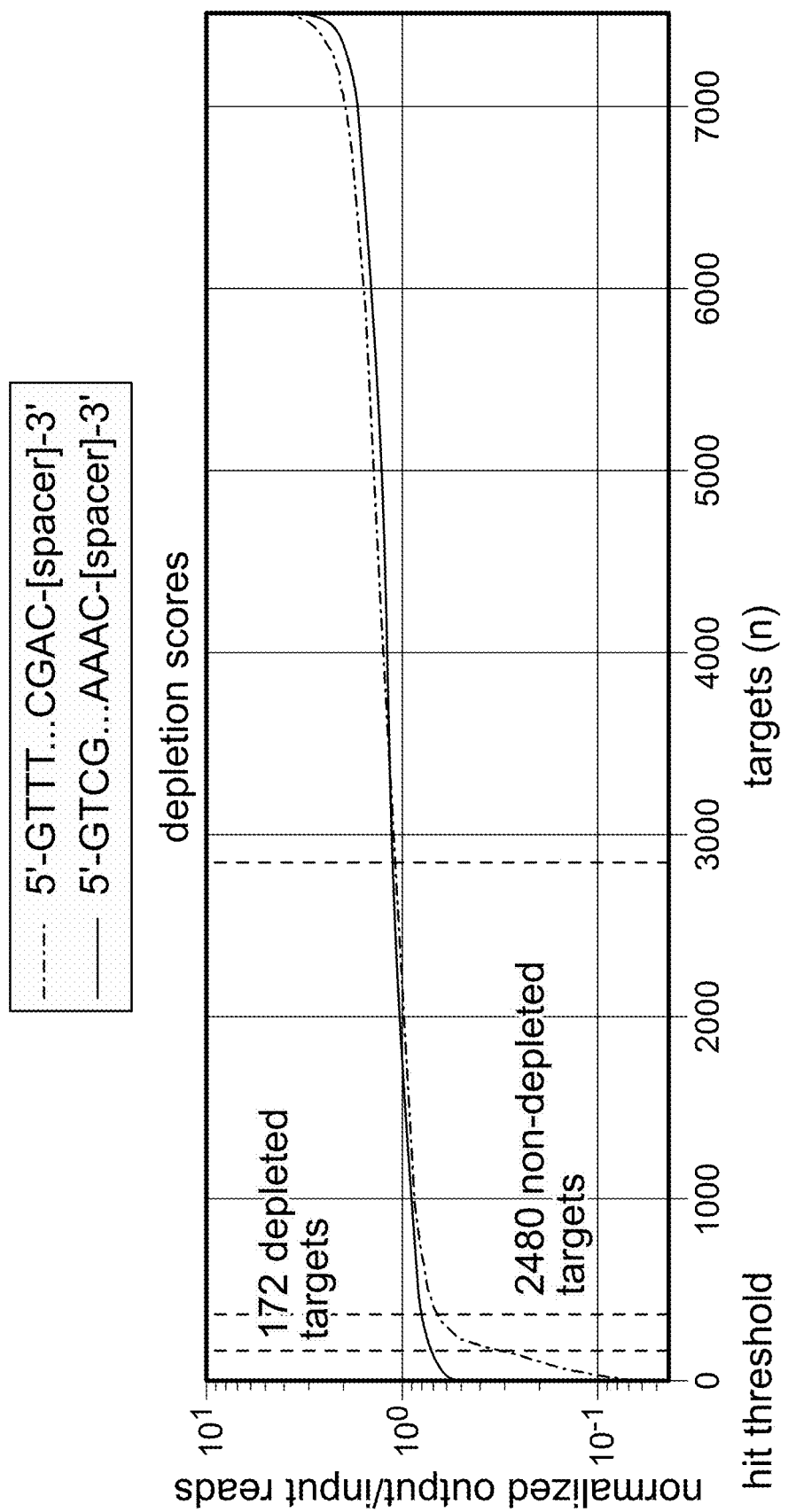
Figure 7B:
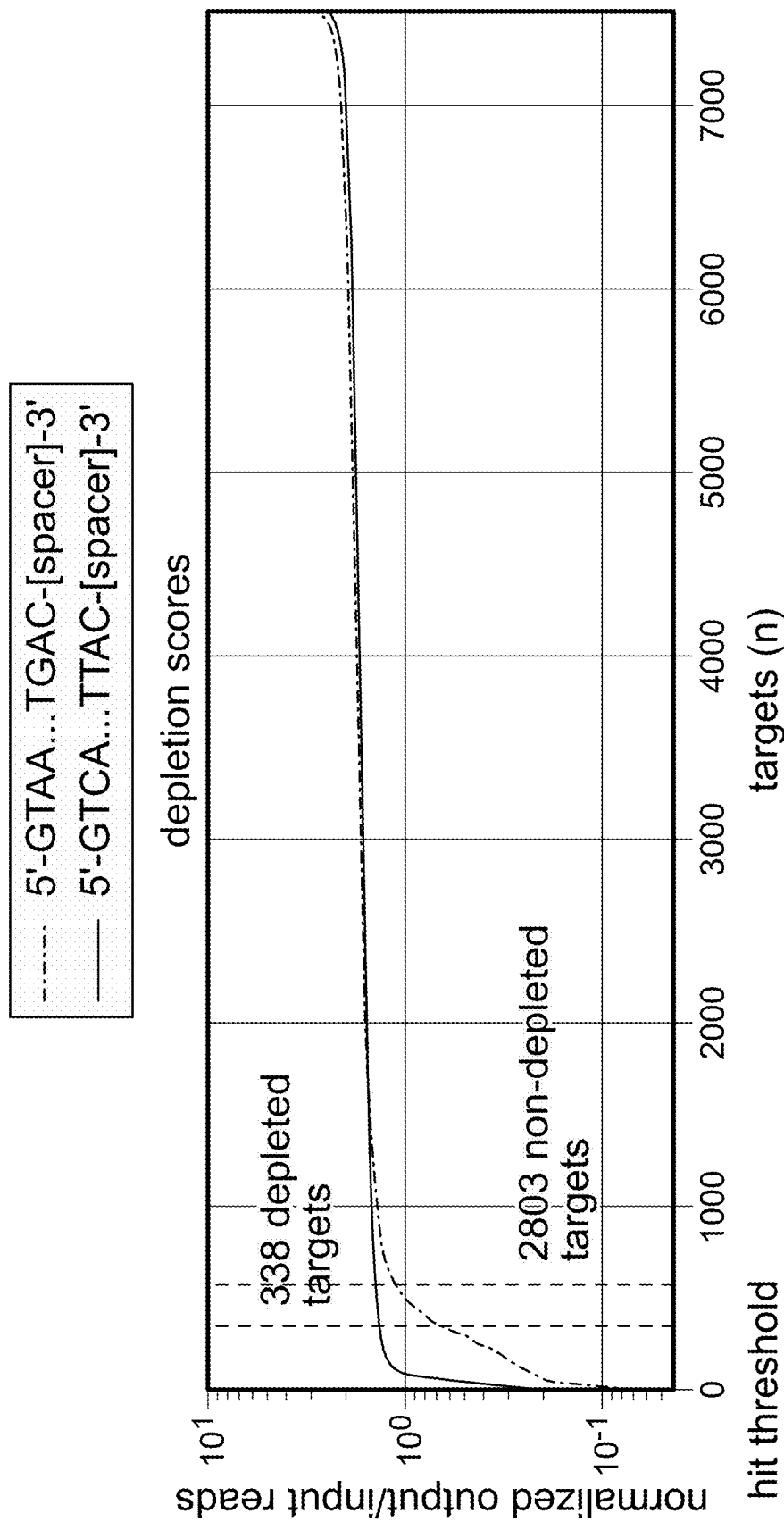
Figure 7C:
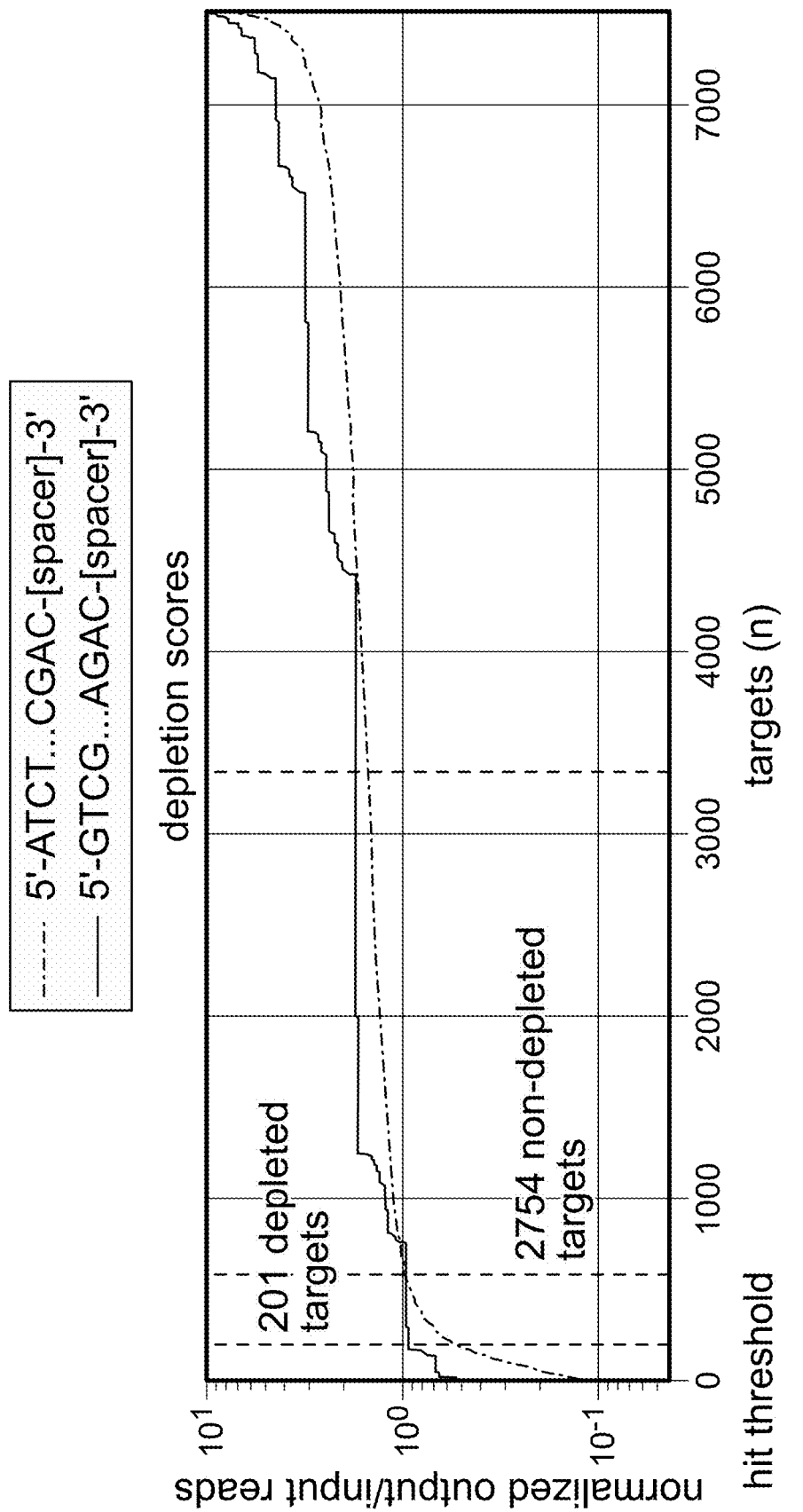
Figure 7D:
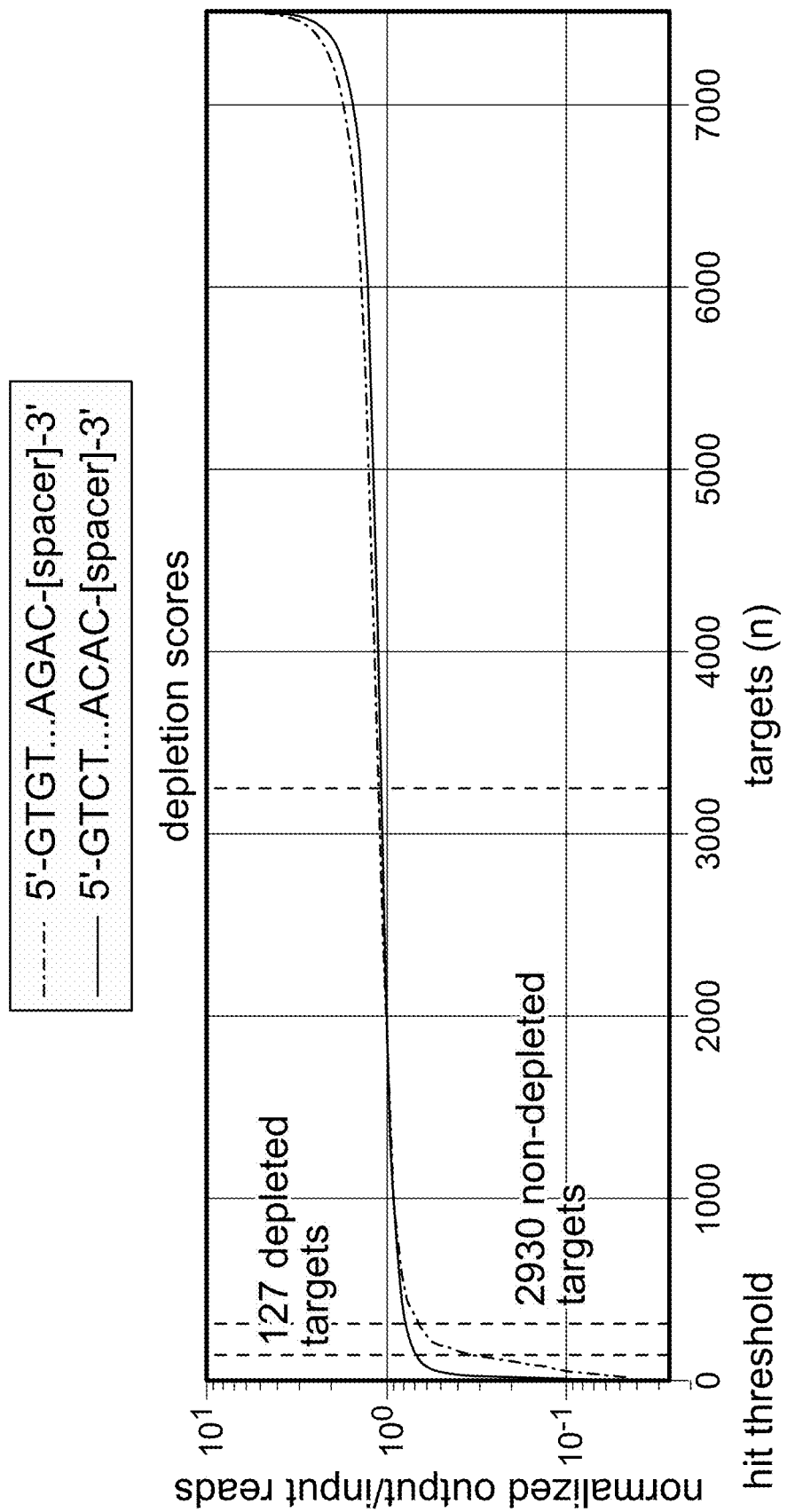
Figure 7E:
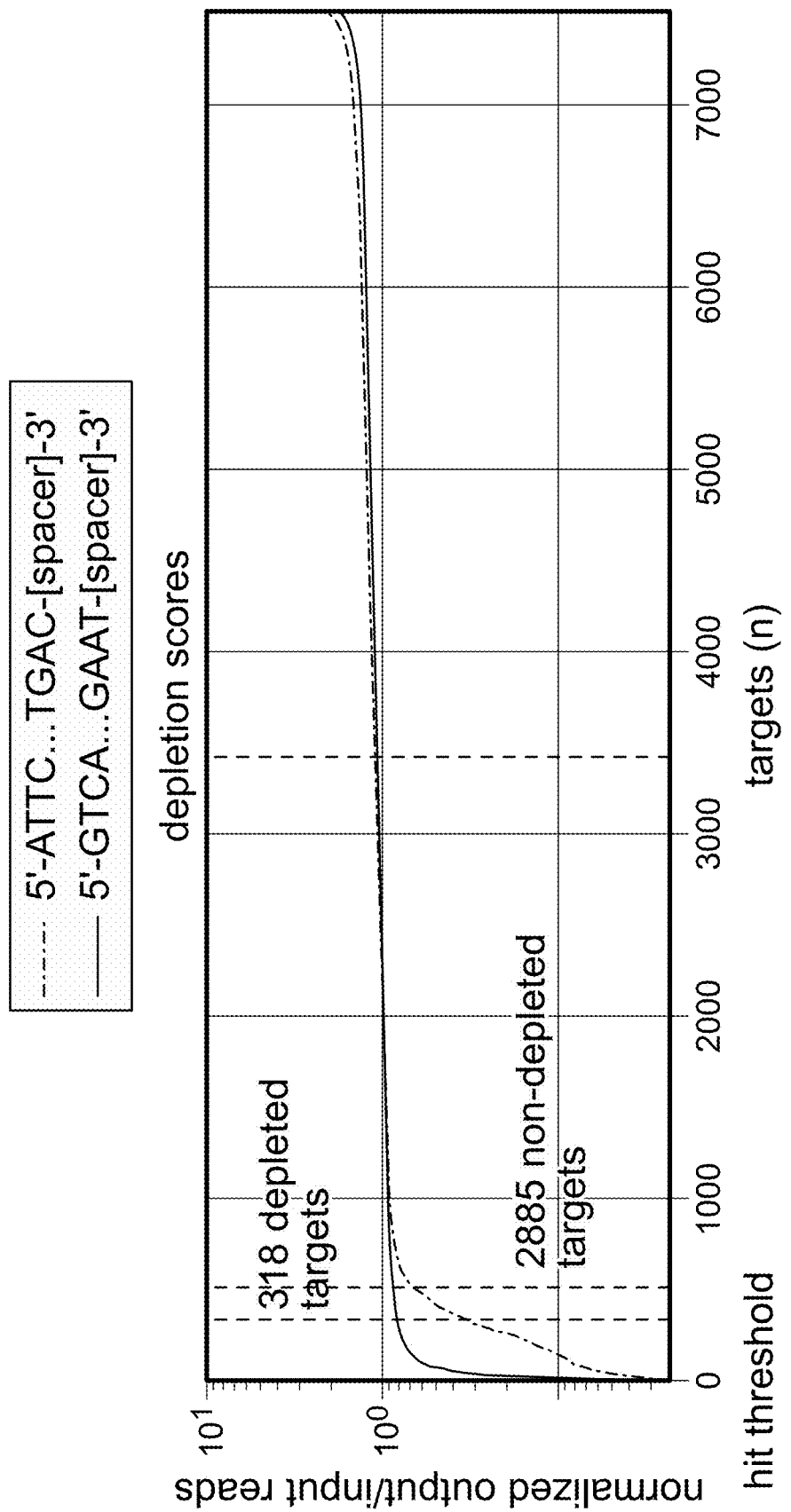
Figure 8A:
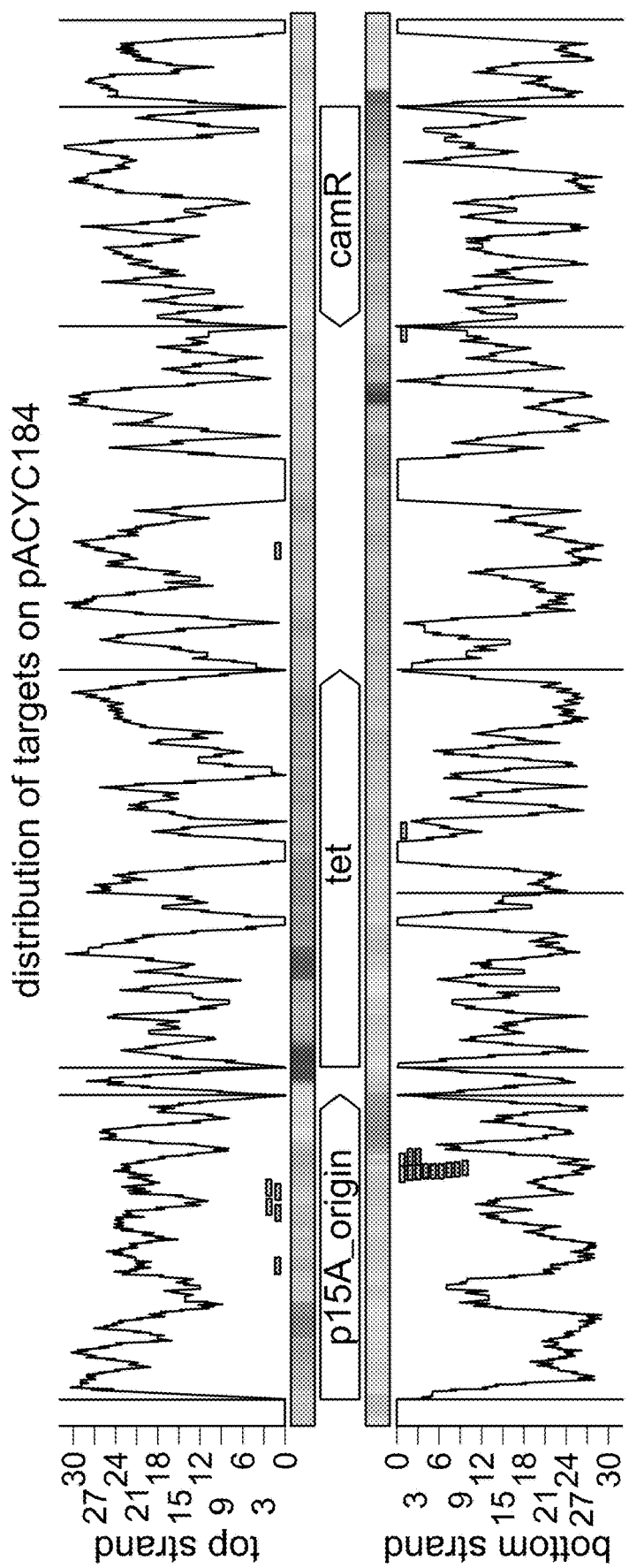
Figure 8B:
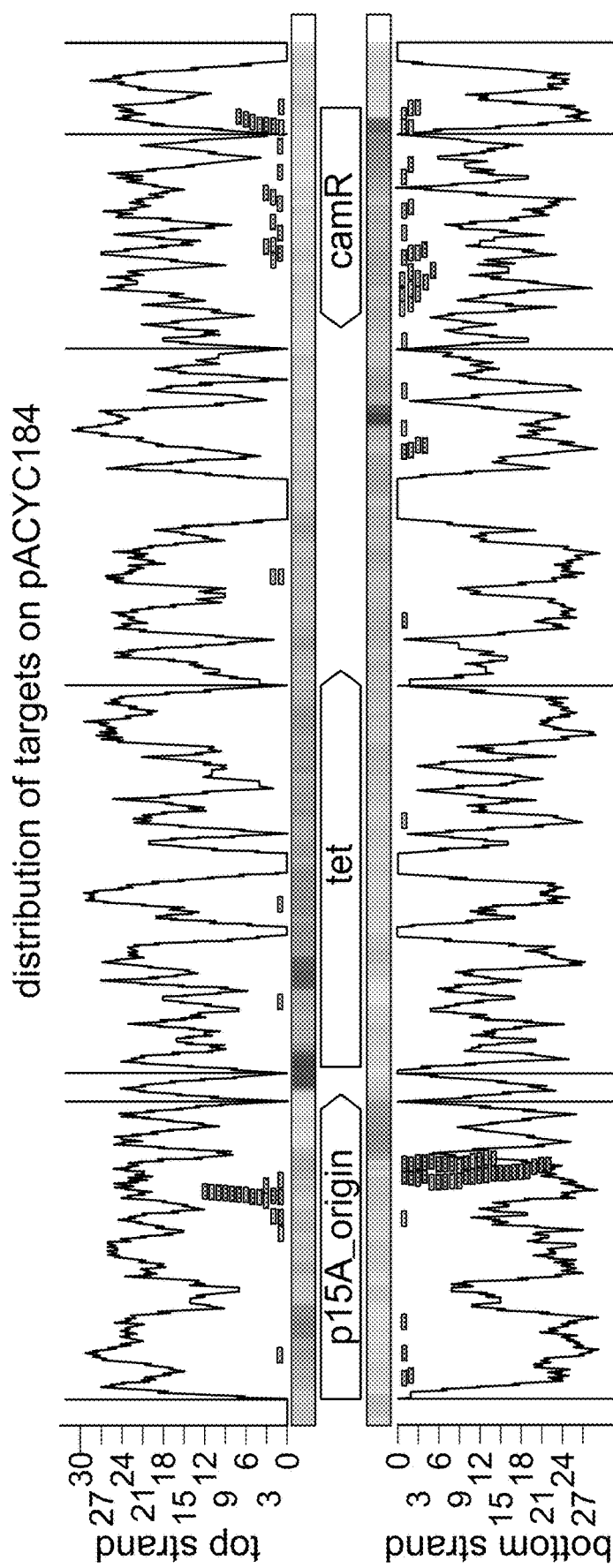
Figure 8C:
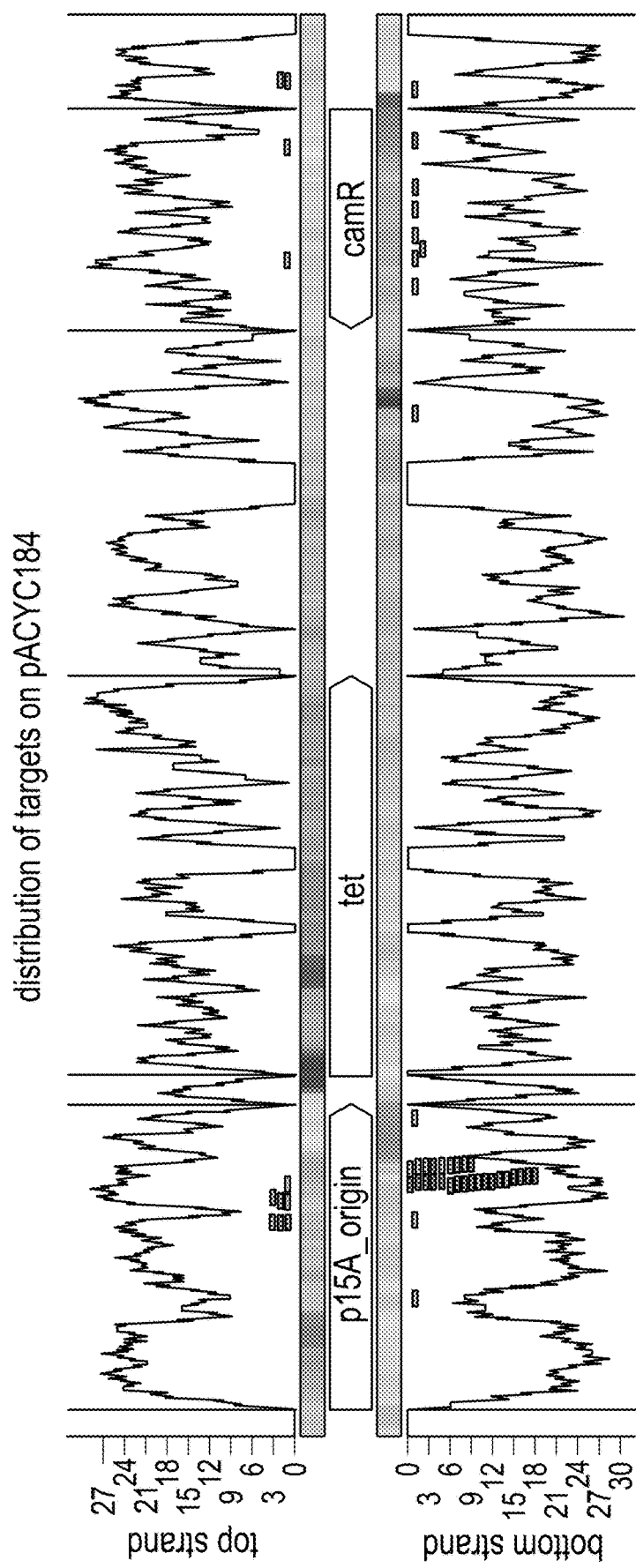
Figure 8D:
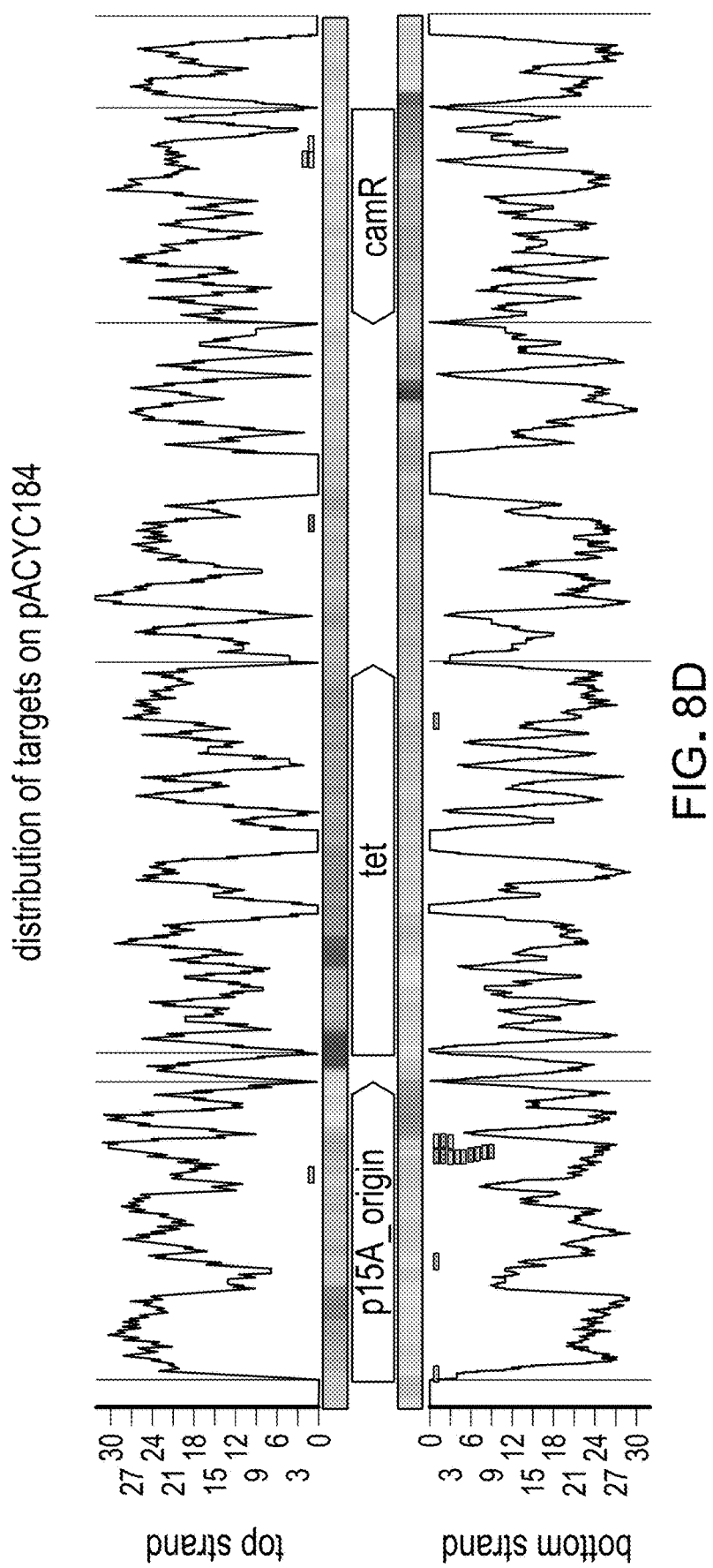
Figure 8E:
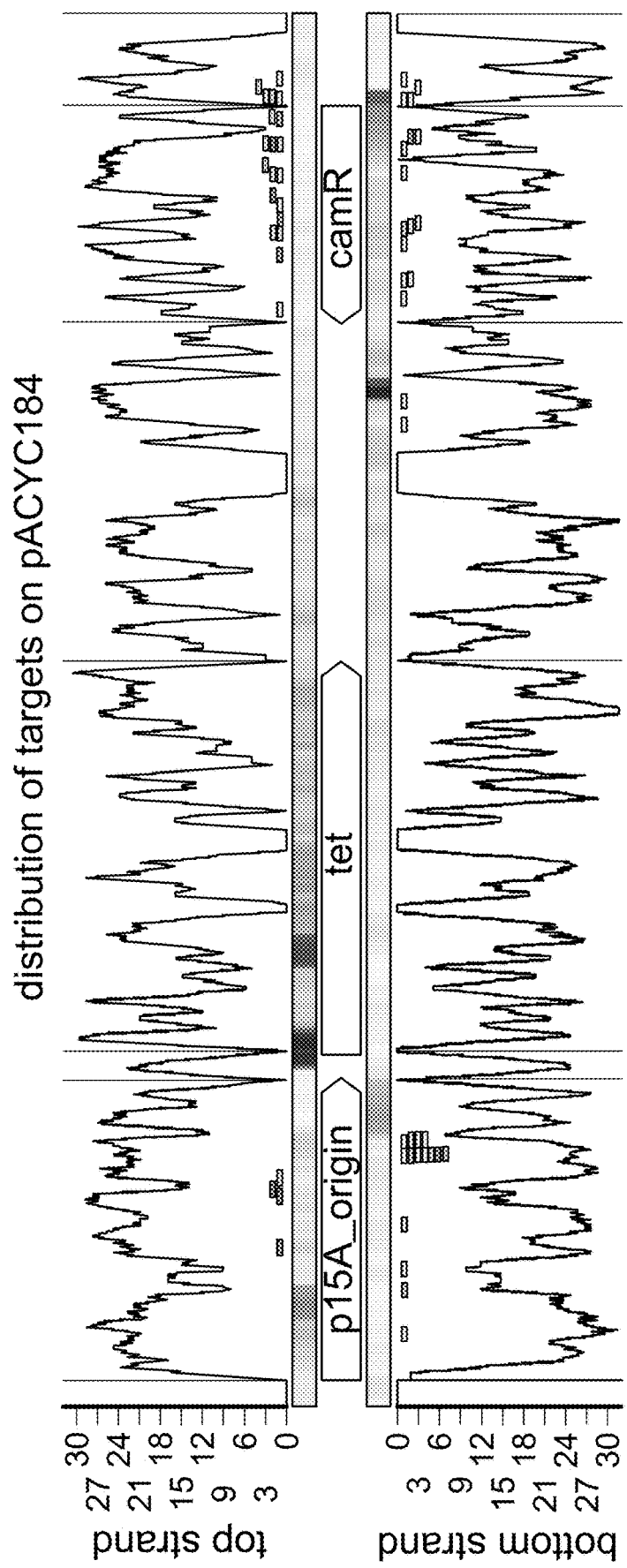
Figure 9A:
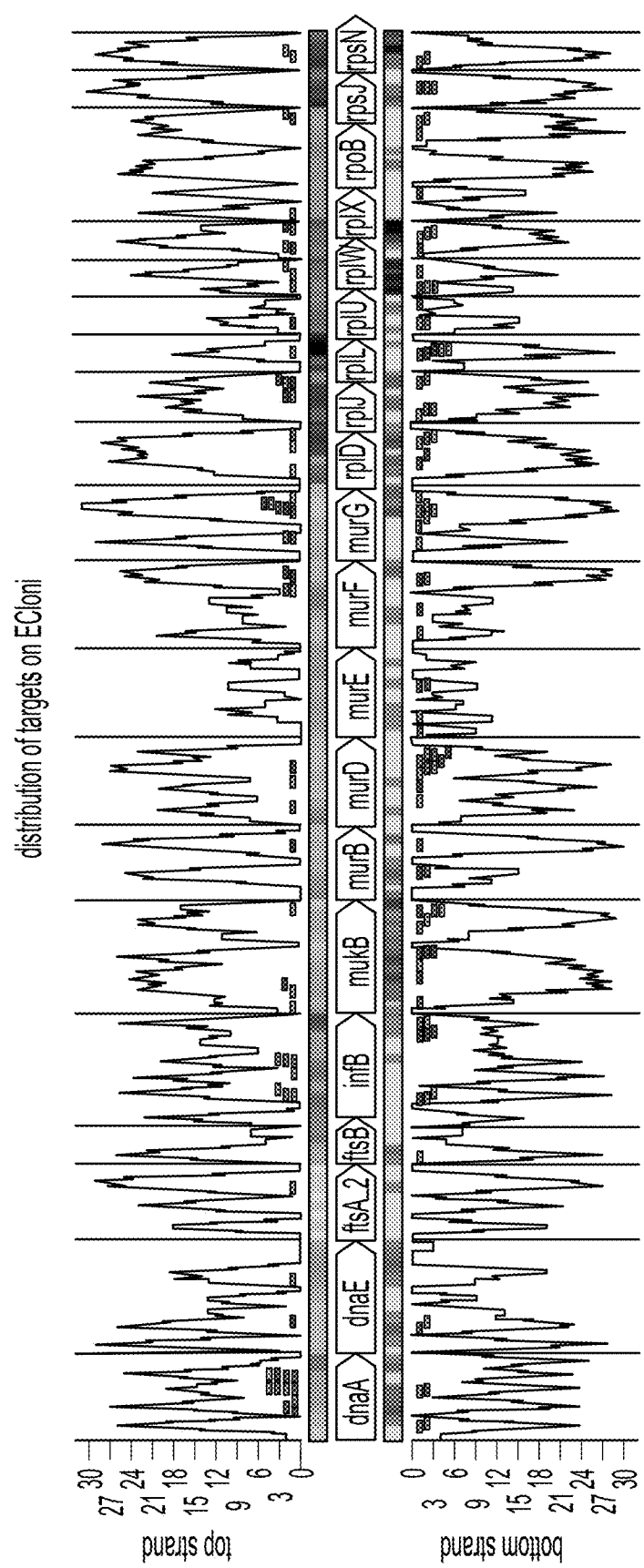
Figure 9B:
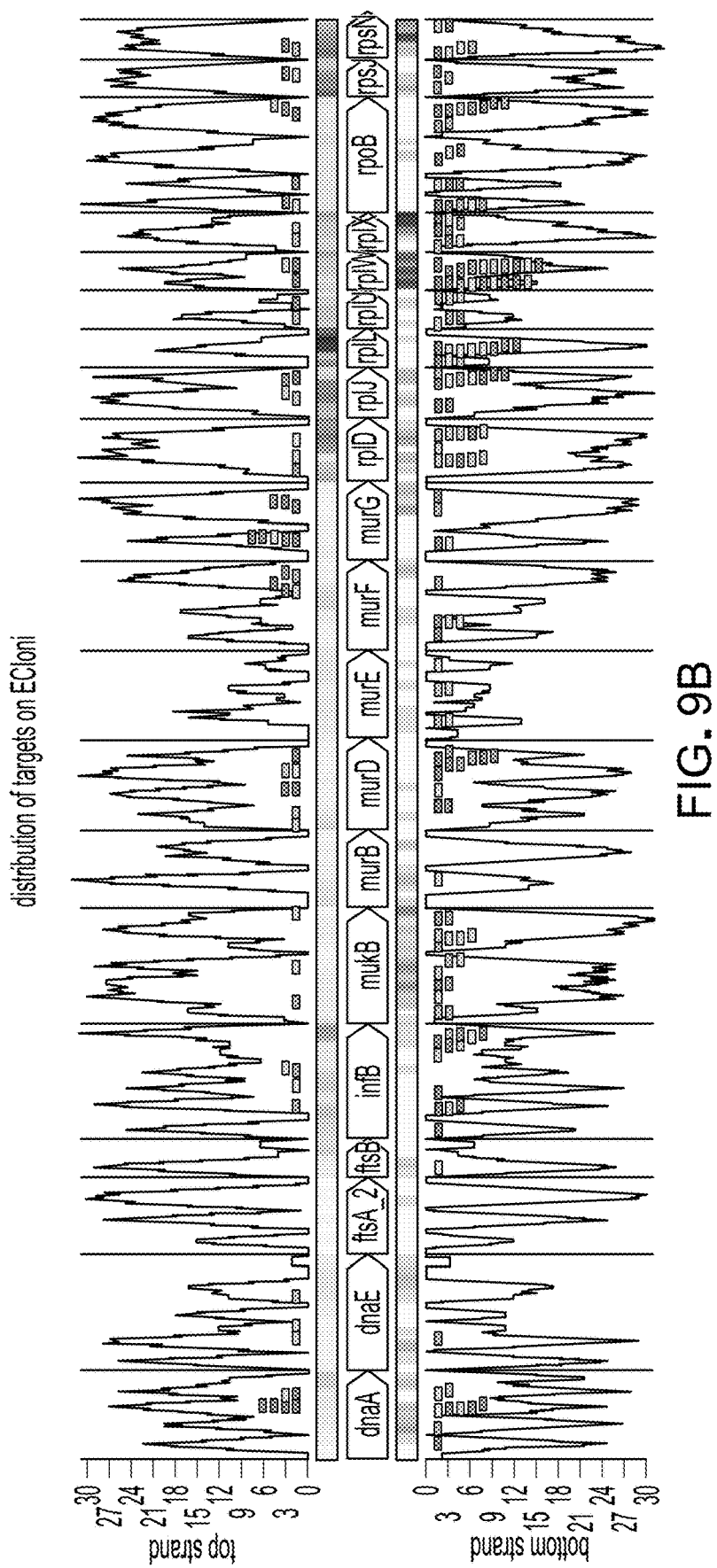
Figure 9C:
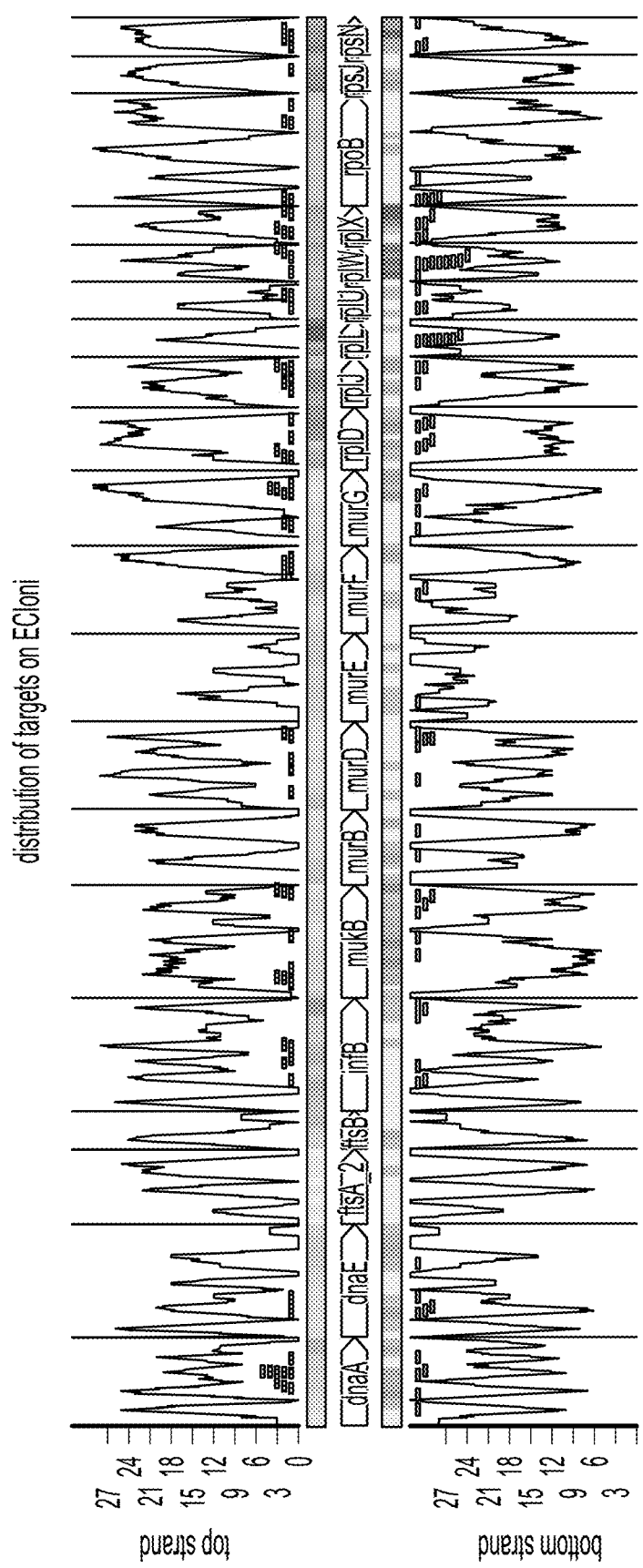
Figure 9D:
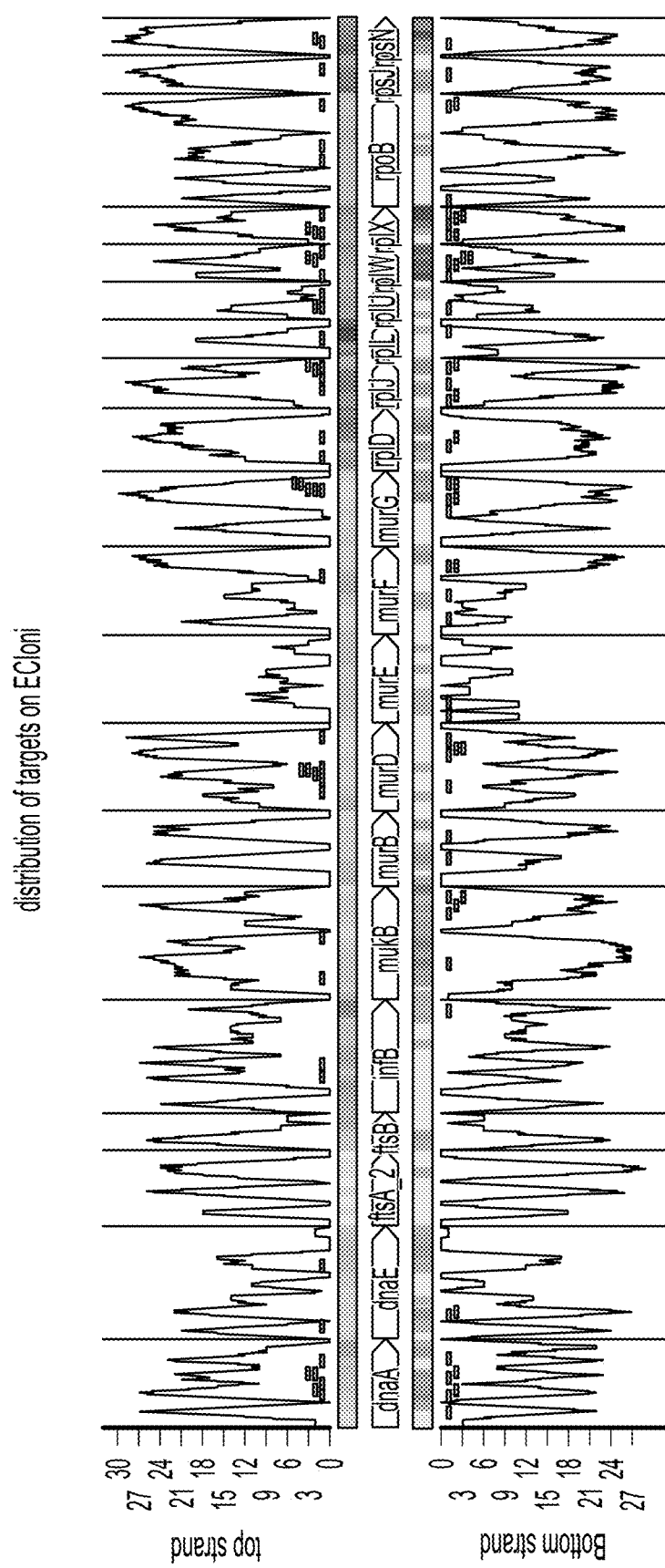
Figure 9E:
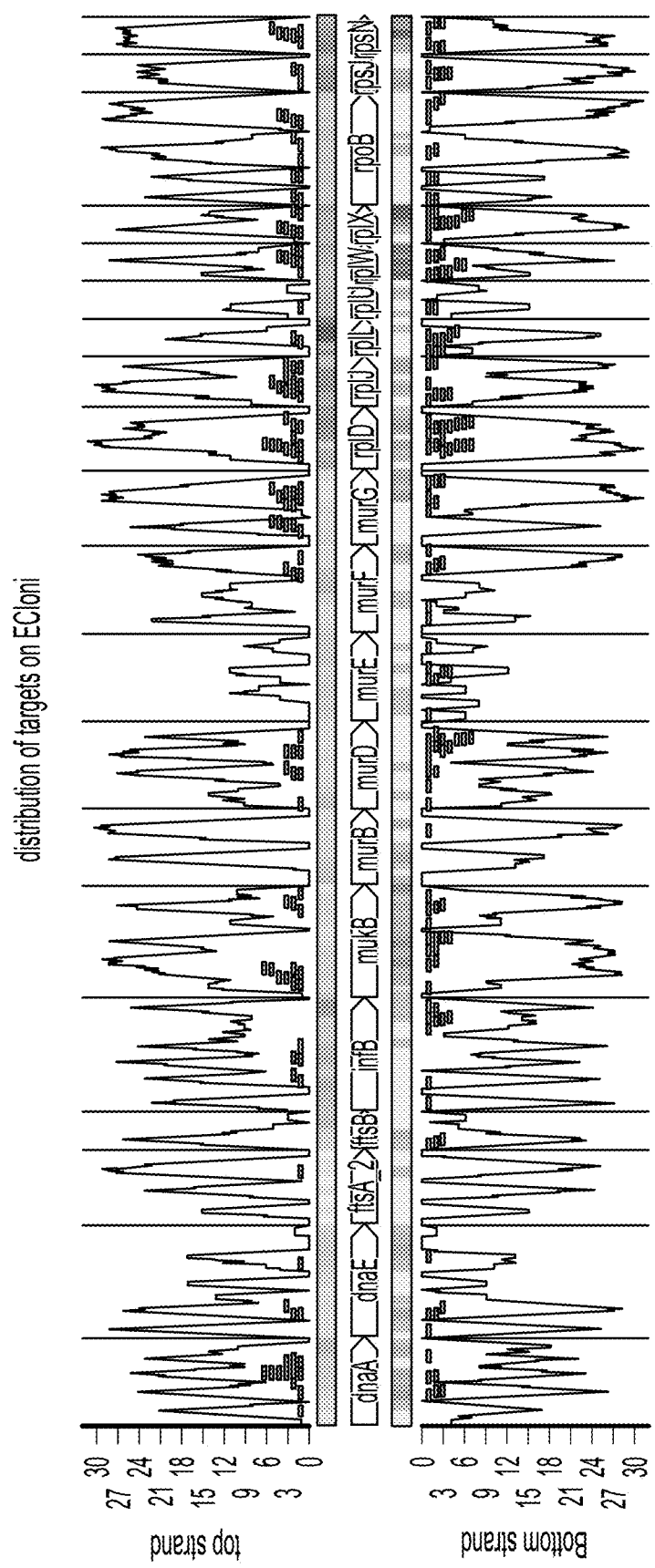
Figure 10A:
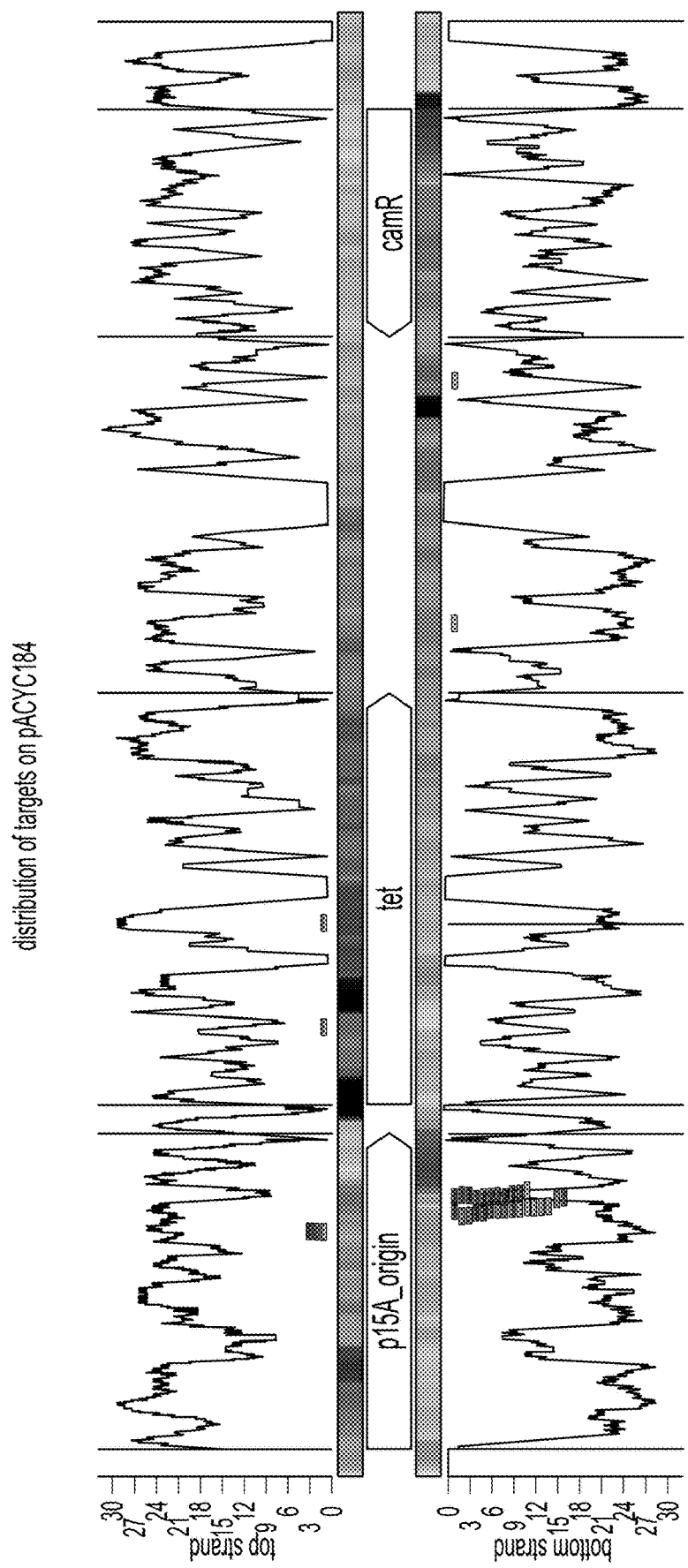
Figure 10B:
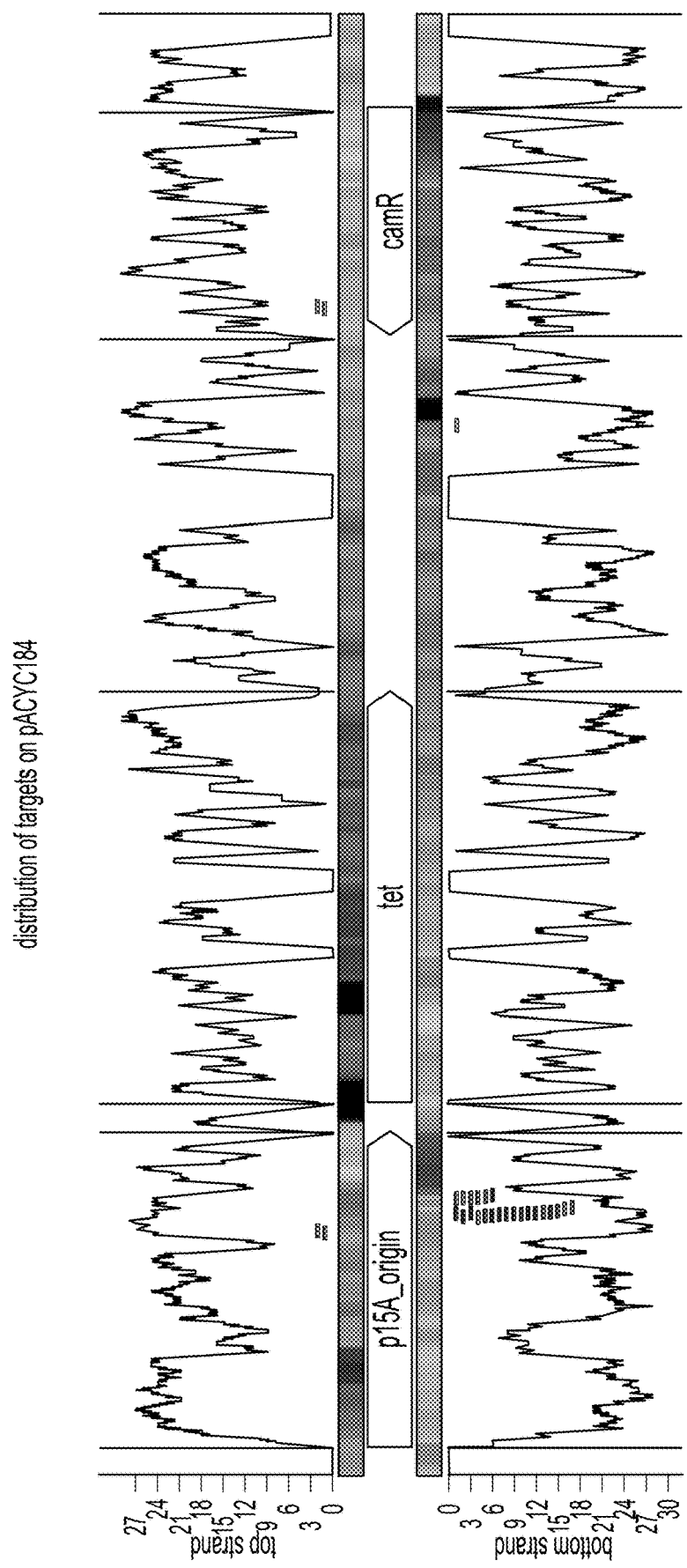
Figure 10C:
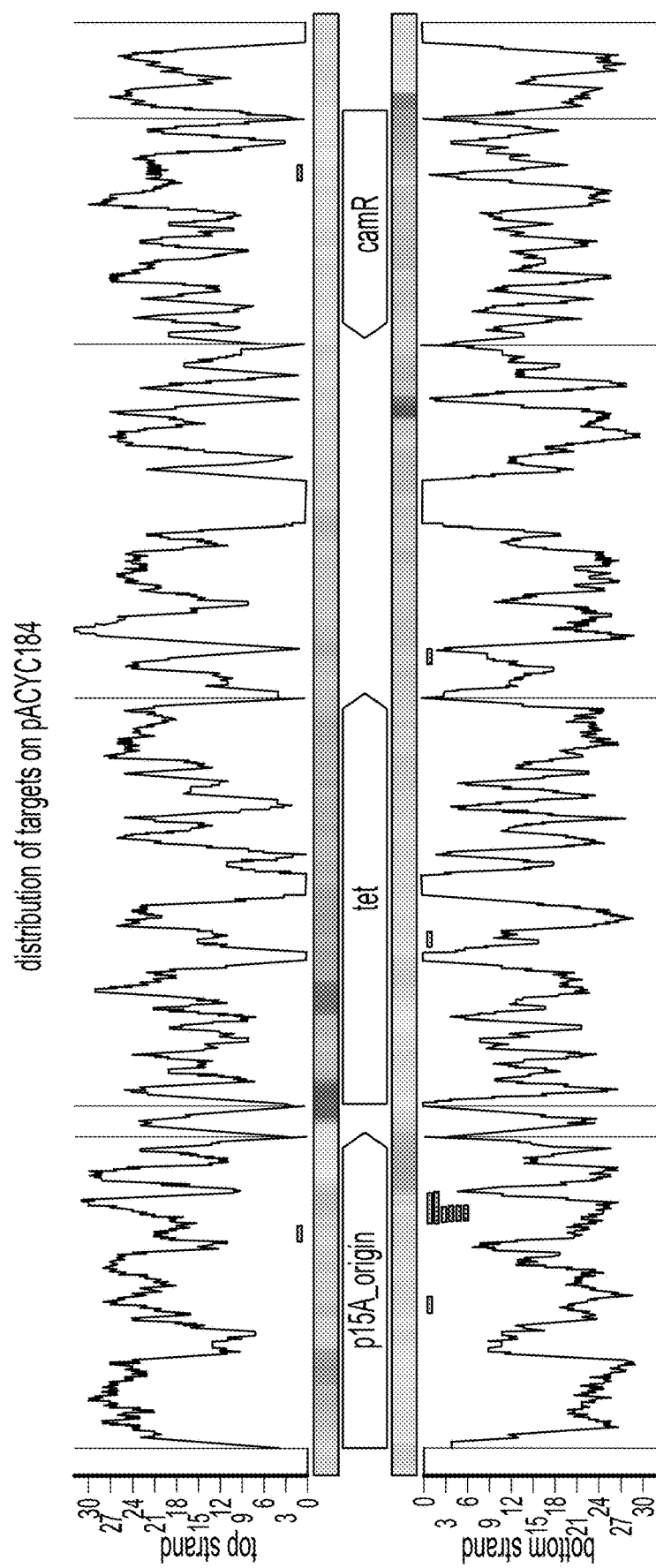
Figure 10D:
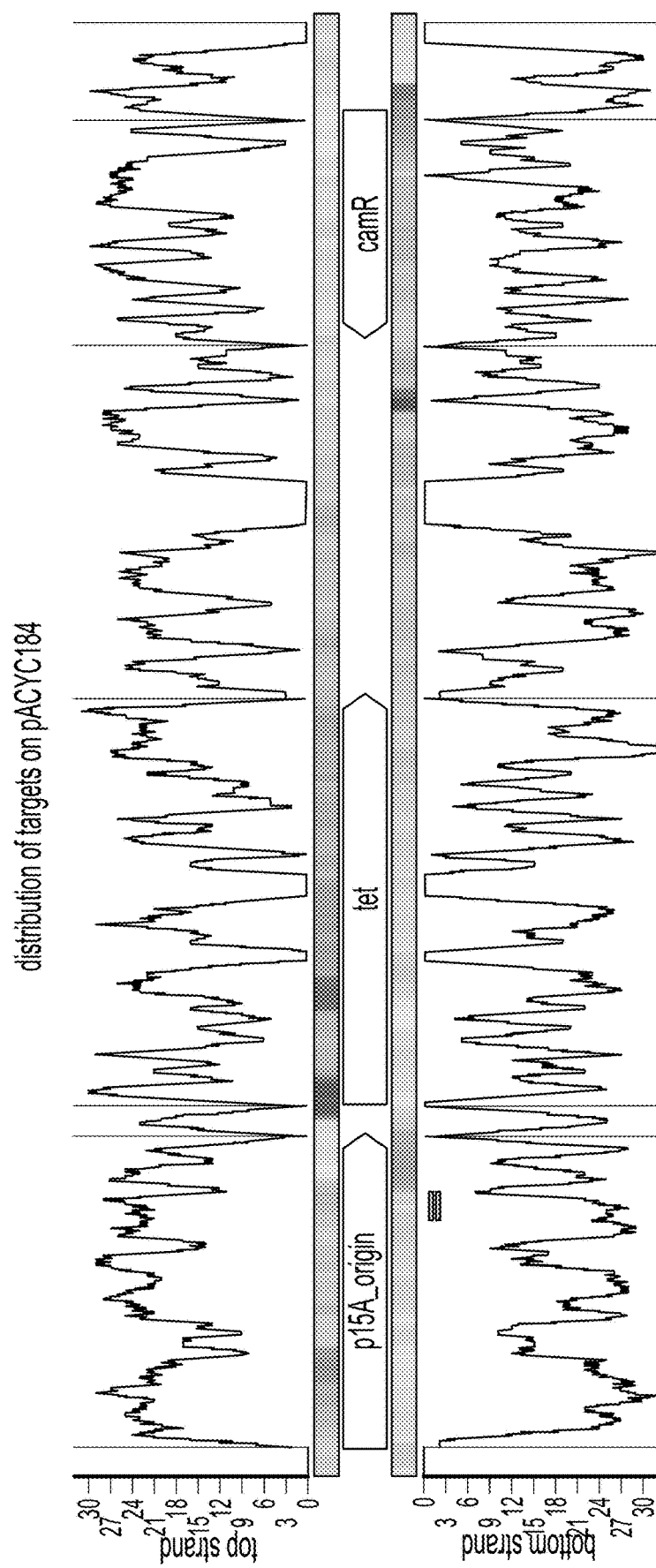
Figure 11A:
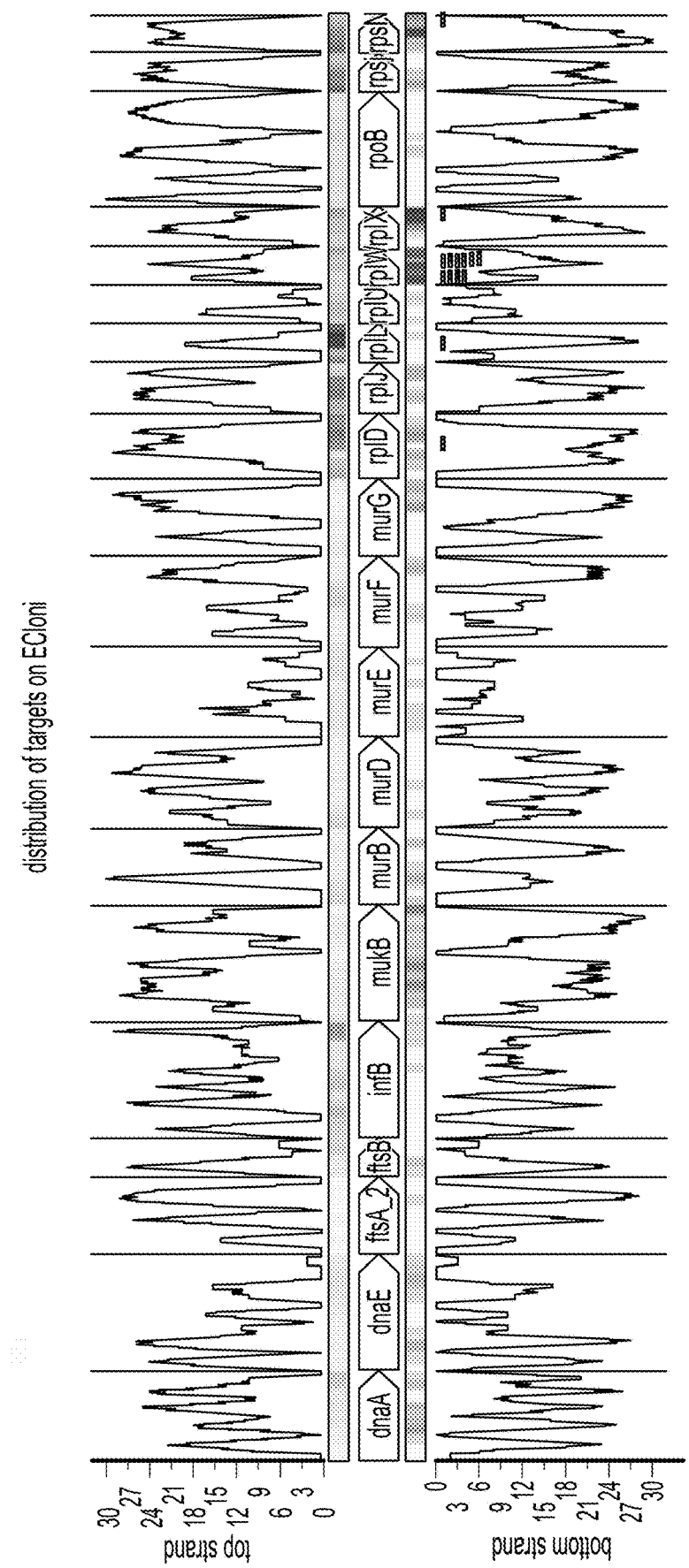
Figure 11B:
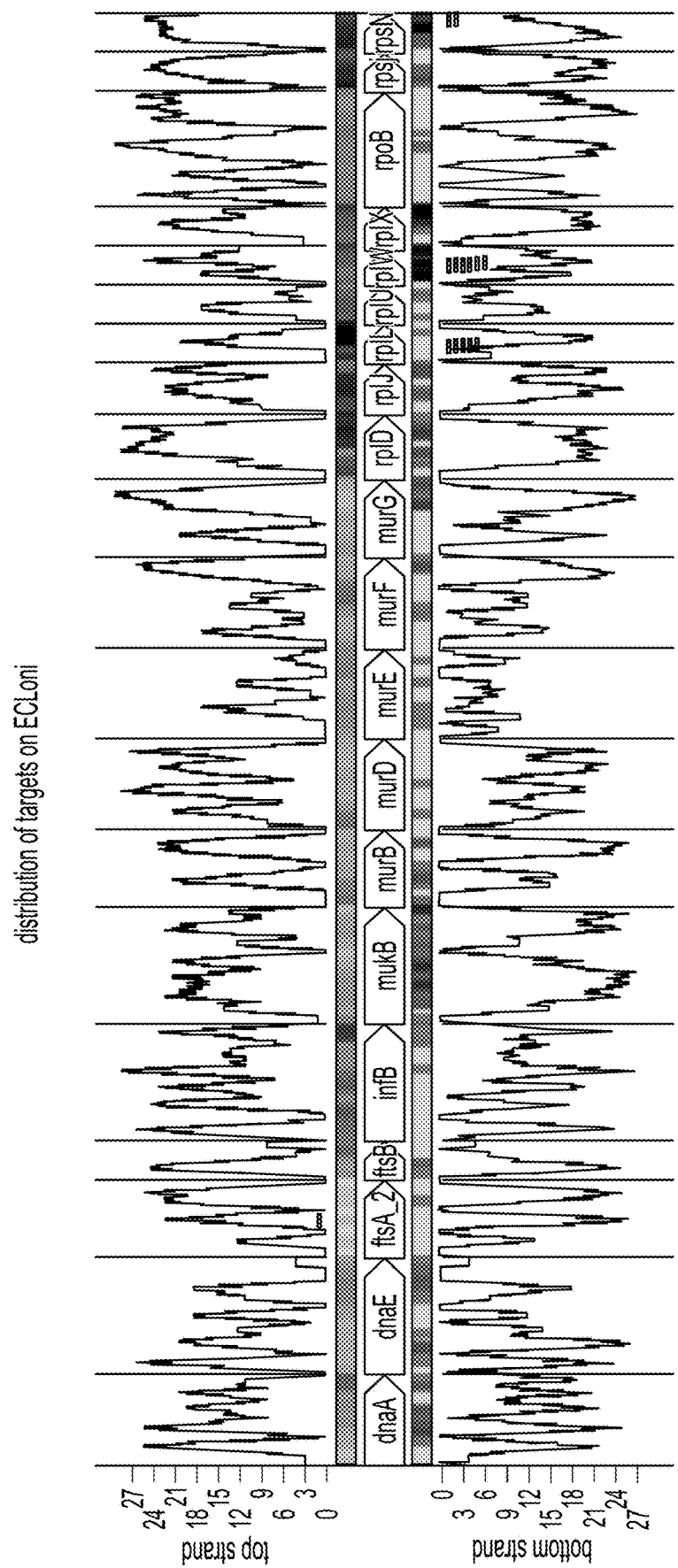
Figure 11C:
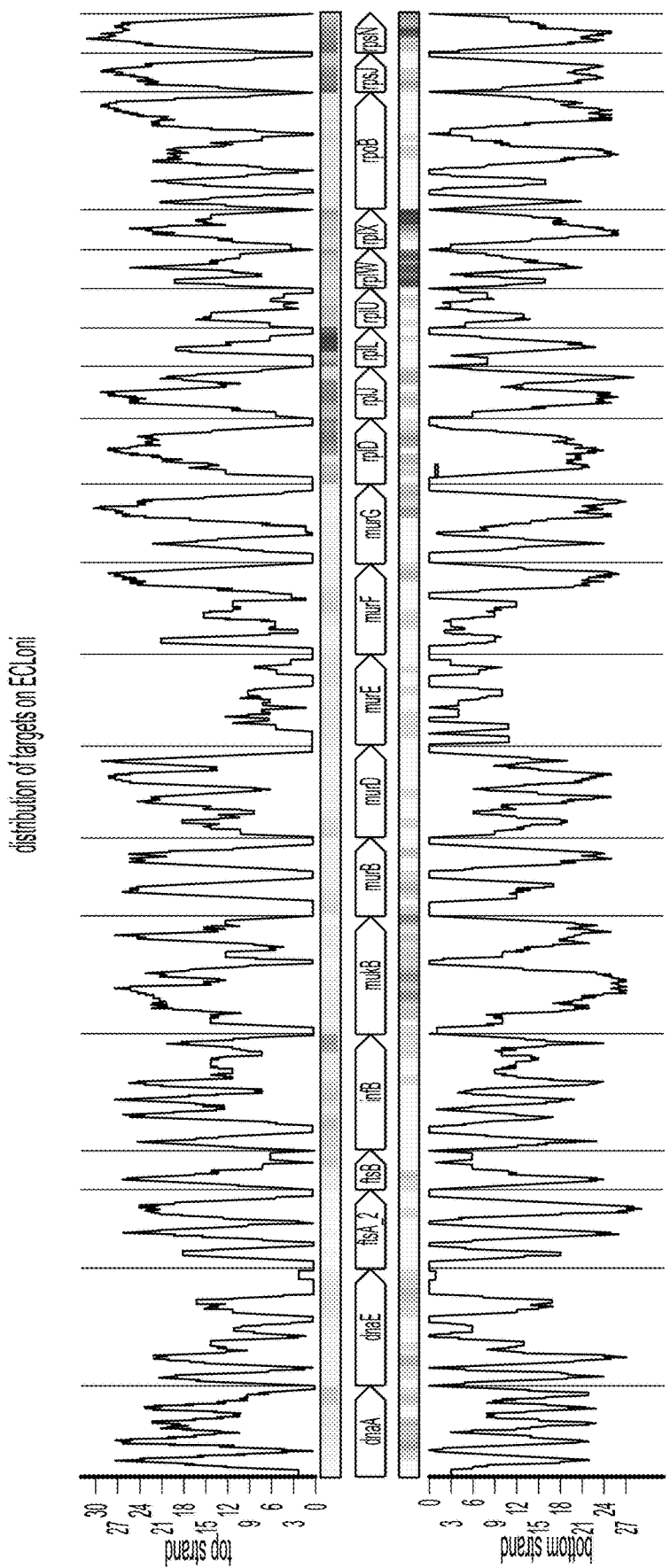
Figure 11D:
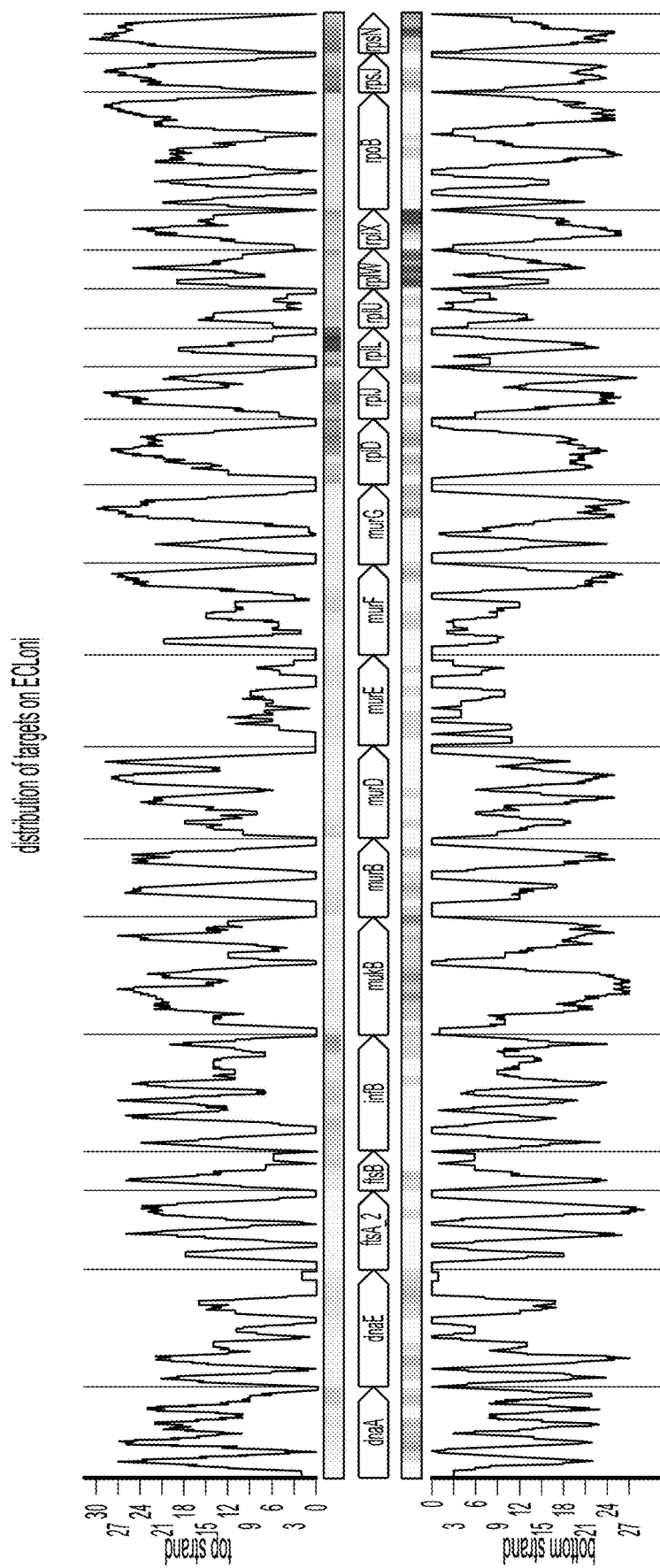
Figure 12A:
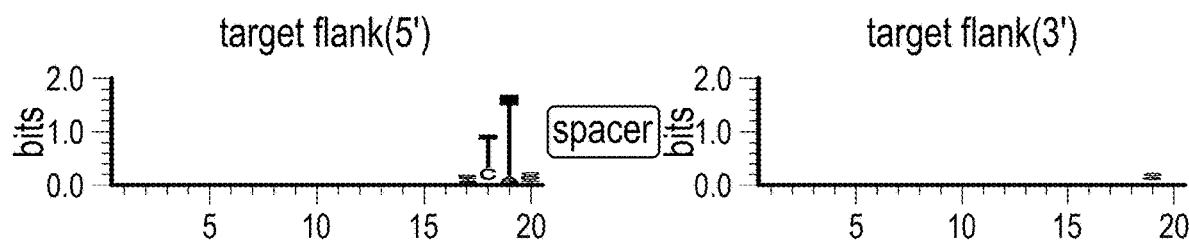
Figure 12B:
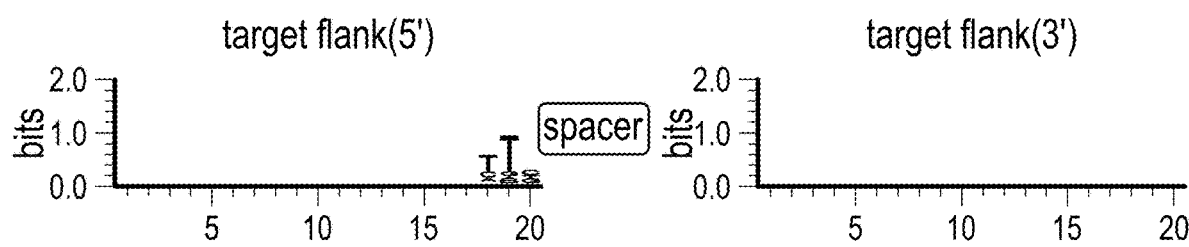
Figure 12C:
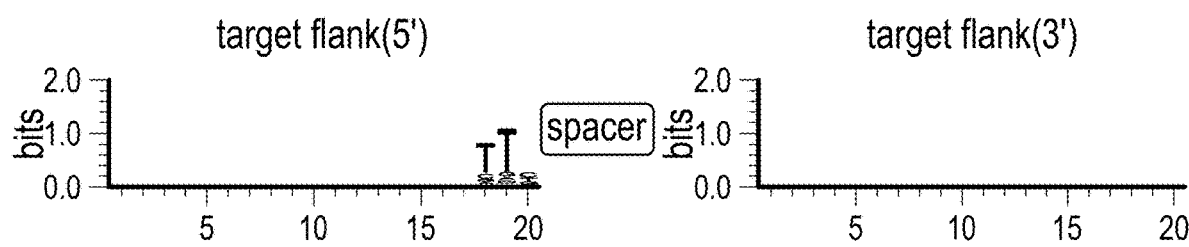
Figure 12D:
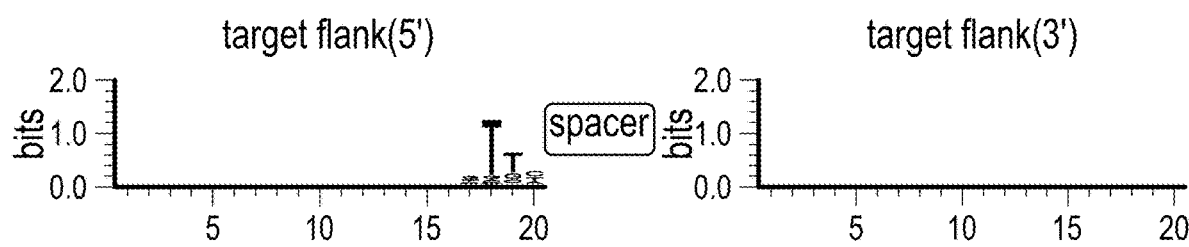
Figure 12E:
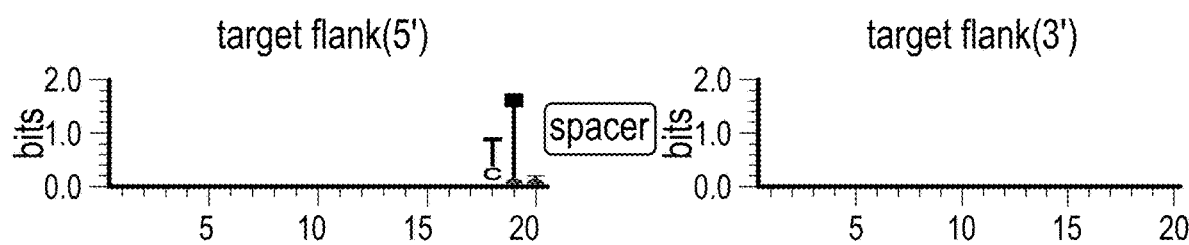

FIG. 5B is a schematic representation of a multiple sequence alignment of CLUST.018837 effector proteins, with the locations of the conserved catalytic residues of the RuvC domain indicated by the short bars and RuvC-I/II/III annotations above the alignment.

Figure 6C:
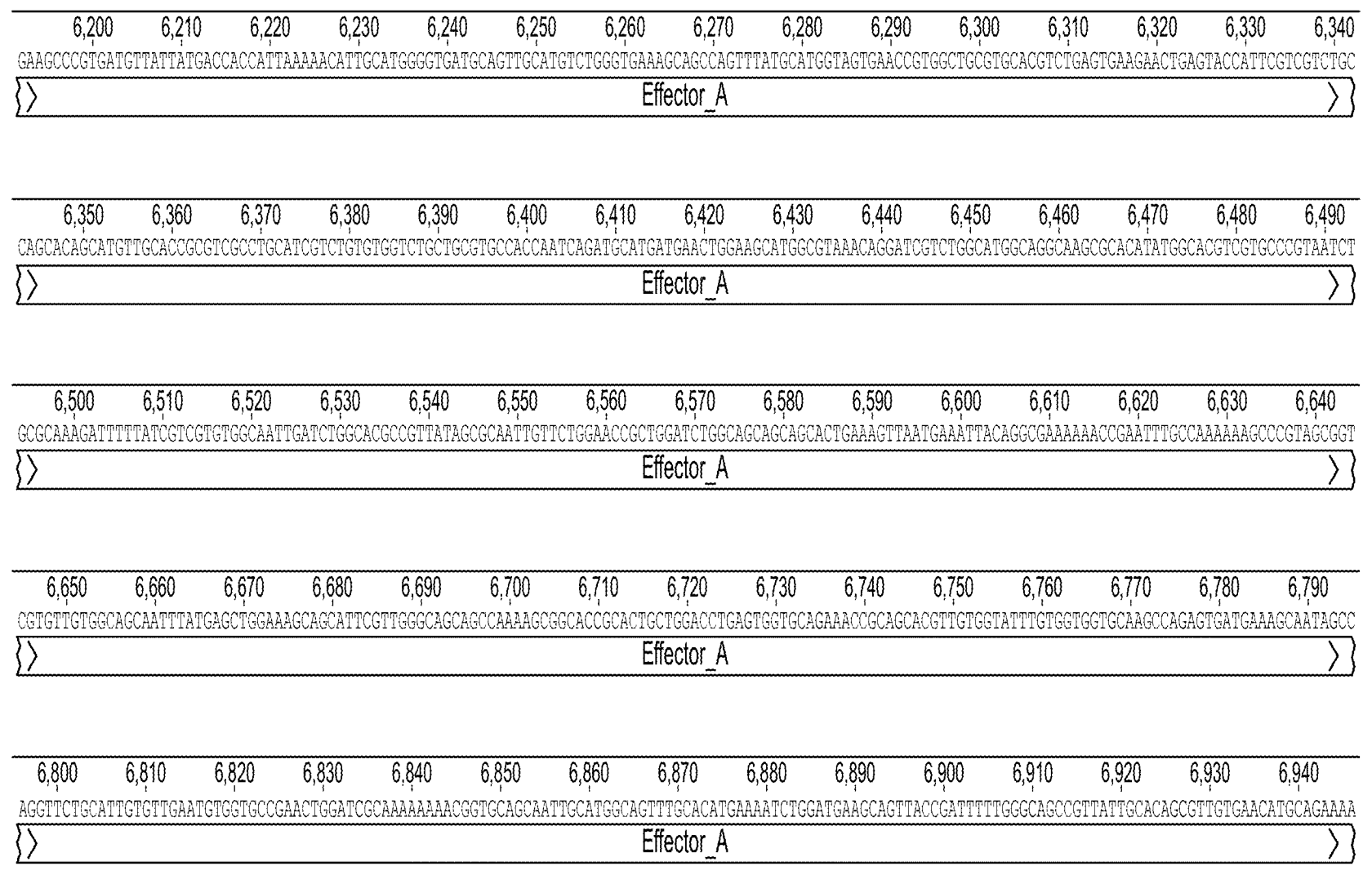

FIGS. 6A, 6B, 6C, and 6D are a series of schematic representations that together show an example of an engineered, non-naturally occurring construct for the CLUST.018837 CRISPR-Cas system containing the NZ_LDOS01000005 effector protein and CRISPR array, both expressed separately from artificial promoters. FIGS. 6A, 6B, 6C and 6D disclose SEQ ID NO: 1044.

FIGS. 7A, 7B, 7C, 7D, and 7E are graphs show the degree of depletion activity of the engineered constructs for CRISPR-Cas systems NZ_LDOS01000005, 3300009004, APMI01033782, NZ_LVXZ01000012, and ADIG01000806, respectively.

FIGS. 8A, 8B, 8C, 8D, and 8E are graphic representations that show the location of strongly depleted targets on the pACYC184 plasmid for the engineered CLUST.018837 CRISPR-Cas systems NZ_LDOS01000005, 3300009004, APMI01033782, NZ_LVXZ01000012, and ADIG01000806, respectively. Depleted targets on the top strand and bottom strand are shown separately, and in relation to the orientation of the annotated genes. Depleted targets are depicted by gray bars, with the length of the bar corresponding to the length of the matching spacer, and the shade corresponding to the magnitude of depletion (darker shades corresponding to more depletion). The light gray line indicates the total number of screened spacers targeting each nucleotide position, and the vertical gray lines delineate the boundaries between two features (e.g. tetracycline-resistance gene and the adjacent non-coding region).

FIGS. 9A, 9B, 9C, 9D, and 9E are graphic representations that show the locations of strongly depleted targets relative to the targeted *E. coli* essential genes for the engineered CLUST.018837 CRISPR-Cas systems NZ_LDOS01000005, 3300009004, APMI01033782, NZ_LVXZ01000012, and ADIG01000806, respectively.

FIGS. 10A, 10B, 10C, and 10D are graphic representations that show the locations of strongly depleted targets on the pACYC184 plasmid for the "effector deletion" (negative control) CLUST.018837 CRISPR-Cas constructs for 3300009004, APMI01033782, NZ_LVXZ01000012, and ADIG01000806, respectively.

FIGS. 11A, 11B, 11C, and 11D are graphic representations that show the locations of strongly depleted targets relative to the targeted *E. coli* essential genes for the "effector deletion" (negative control) CLUST.018837 CRISPR-Cas constructs for 3300009004, APMI01033782, NZ_LVXZ01000012, and ADIG01000806, respectively.

FIGS. 12A, 12B, 12C, 12D, and 12E are weblogos of the sequences flanking the sites of strongly depleted targets for the engineered CLUST.018837 CRISPR-Cas systems NZ_LDOS01000005, 3300009004, APMI01033782, NZ_LVXZ01000012, and ADIG01000806, respectively.

Figure 13A:
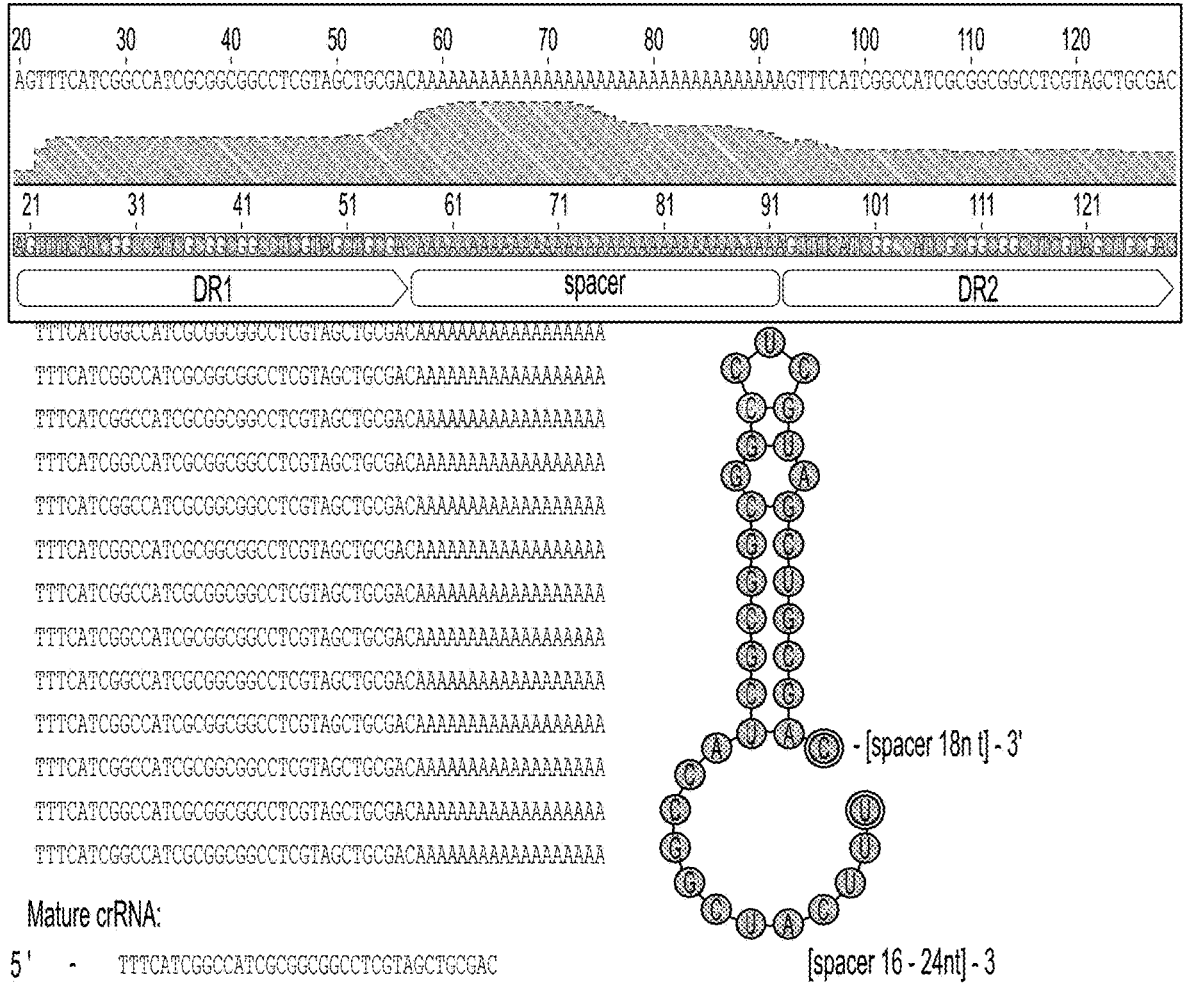
Figure 13B:
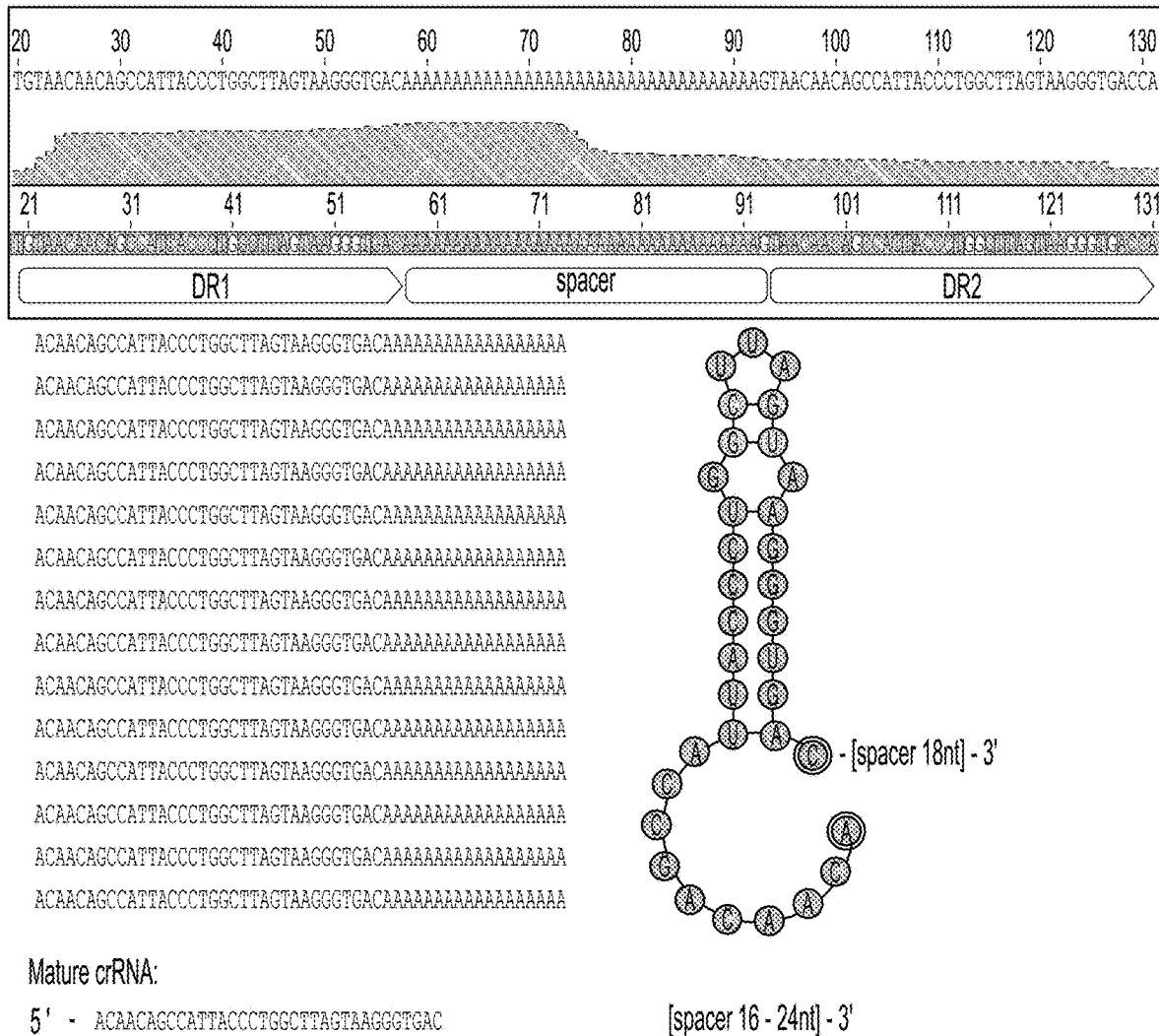
Figure 13C:
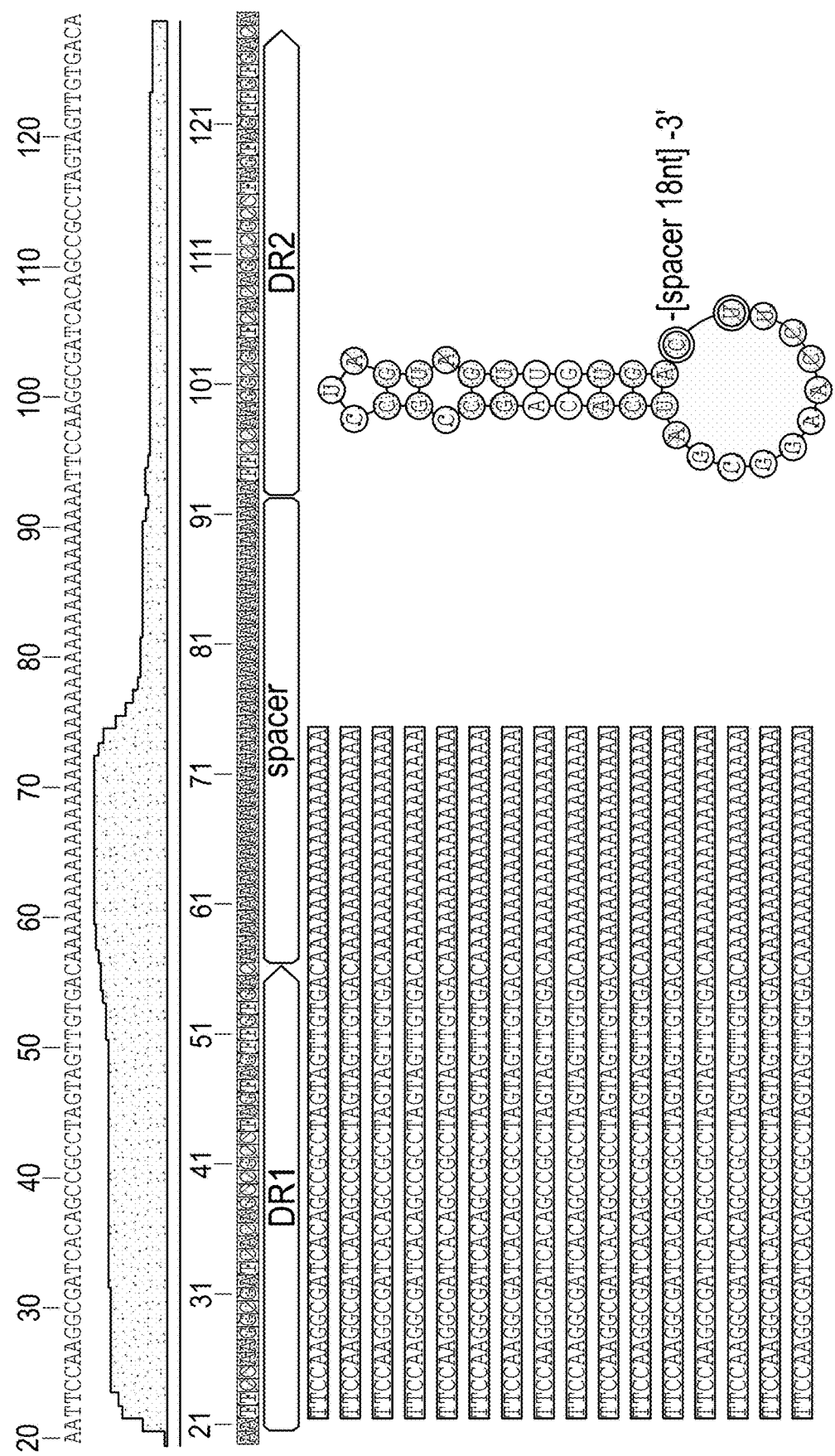

FIGS. 13A, 13B, and 13C show the mature crRNA (comprising a direct repeat and a spacer) for exemplary CLUST.018837 CRISPR-Cas systems NZ_LDOS01000005, 3300009004, and ADIG01000806, respectively. FIGS. 13A, 13B, and 13C also show sequence alignments of RNA-sequenced transcripts including the processed form of the direct repeat and the orientation of the spacer with regard to the direct repeat on the mature crRNA, the processed crRNA sequence, and the secondary structure of a mature crRNA for exemplary CLUST.018837 CRISPR-Cas systems, NZ_LDOS01000005, 3300009004, and ADIG01000806, respectively. FIG. 13A discloses SEQ ID NOS 1045, 1045-1046, 1046, 1046, 1046, 1046, 1046, 1046, 1046, 1046, 1046, 1046, 1046, 1046-1047 and the hairpin sequence as SEQ ID NO: 1048, FIG. 13B discloses SEQ ID NOS 1049, 1049-1050, 1050, 1050, 1050, 1050, 1050, 1050, 1050, 1050, 1050, 1050, 1050, 1050, 1050-1051 and the hairpin sequence as SEQ ID NO. 1052, and FIG. 13C discloses SEQ ID NOS 1053, 1053-1054, 1054, 1054, 1054, 1054, 1054, 1054, 1054, 1054, 1054, 1054, 1054, 1054, 1054, 1056 and the hairpin sequence as SEQ ID NO: 1055, all respectively, in order of appearance.

Figure 14:

FIG. 14 is an image of a gel that shows processing of the pre-crRNA into a mature crRNA by the NZ_LDOS01000005 effector protein in a dose-dependent manner. Pre-crRNA processing in the presence of EDTA suggests that magnesium is not required.

DETAILED DESCRIPTION

The broad natural diversity of CRISPR-Cas defense systems contains a wide range of activity mechanisms and functional elements that can be harnessed for programmable biotechnologies. In a natural system, these mechanisms and parameters enable efficient defense against foreign DNA and viruses while providing self vs. non-self discrimination to avoid self-targeting. In an engineered system, the same mechanisms and parameters also provide a diverse toolbox of molecular technologies and define the boundaries of the targeting space. For instance, systems Cas9 and Cas13a have canonical DNA and RNA endonuclease activity and their targeting spaces are defined by the protospacer adjacent motif (PAM) on targeted DNA and protospacer flanking sites (PFS) on targeted RNA, respectively.

The methods described herein can be used to discover additional mechanisms and parameters within single subunit Class 2 effector systems that can be more effectively harnessed for programmable biotechnologies.

In one aspect, the disclosure relates to the use of computational methods and algorithms to search for and identify novel protein families that exhibit a strong co-occurrence pattern with certain other features within naturally occurring genome sequences. In certain exemplary embodiments, these computational methods are directed to identifying protein families that co-occur in close proximity to CRISPR arrays. However, the methods disclosed herein are useful in identifying proteins that naturally occur within close proximity to other features, both non-coding and protein-coding (for example, CRISPR Cas1 proteins). It should be understood that the methods and calculations described herein may be performed on one or more computing devices.

In some embodiments, a set of genomic sequences may be obtained from genomic or metagenomic databases. The databases comprise short reads, or contig level data, or assembled scaffolds, or complete organisms. Likewise, the database may comprise genomic sequence data from prokaryotic organisms, or eukaryotic organisms, or may include data from metagenomic environmental samples. Exemplary database repositories include NCBI RefSeq, NCBI GenBank, NCBI Whole Genome Shotgun (WGS), and JGI Integrated Microbial Genomes (IMG).

In some embodiments, a minimum size requirement is imposed to select genome sequence data of a specified minimum length. In certain exemplary embodiments, the minimum contig length may be 100 nucleotides, 500 nt, 1 kb, 1.5 kb, 2 kb, 3 kb, 4 kb, 5 kb, 10 kb, 20 kb, 40 kb, or 50 kb.

In some embodiments, known or predicted proteins are extracted from the complete or a selected set of genome sequence data. In some embodiments, known or predicted proteins are taken from extracting coding sequence (CDS)

annotations provided by the source database. In some embodiments, predicted proteins are determined by applying a computational method to identify proteins from nucleotide sequences. In some embodiments, the GeneMark Suite is used to predict proteins from genome sequences. In some embodiments, Prodigal is used to predict proteins from genome sequences. In some embodiments, multiple protein prediction algorithms may be used over the same set of sequence data with the resulting set of proteins de-duplicated.

In some embodiments, CRISPR arrays are identified from the genome sequence data. In some embodiments, PILER-CR is used to identify CRISPR arrays. In some embodiments, CRISPR Recognition Tool (CRT) is used to identify CRISPR arrays. In some embodiments, CRISPR arrays are identified by a heuristic that identifies nucleotide motifs repeated a minimum number of times (e.g. 2, 3, or 4 times), where the spacing between consecutive occurrences of a repeated motif does not exceed a specified length (e.g. 50, 100, or 150 nucleotides). In some embodiments, multiple CRISPR array identification tools may be used over the same set of sequence data with the resulting set of CRISPR arrays de-duplicated.

In some embodiments, proteins in close proximity to CRISPR arrays are identified. In some embodiments, proximity is defined as a nucleotide distance, and may be within 20 kb, 15 kb, or 5 kb. In some embodiments, proximity is defined as the number of open reading frames (ORFs) between a protein and a CRISPR array, and certain exemplary distances may be 10, 5, 4, 3, 2, 1, or 0 ORFs. The proteins identified as being within close proximity to a CRISPR array are then grouped into clusters of homologous proteins. In some embodiments, blastclust is used to form protein clusters. In certain other embodiments, mmseqs2 is used to form protein clusters.

To establish a pattern of strong co-occurrence between the members of a protein cluster with CRISPR arrays, a BLAST search of each member of the protein family may be performed over the complete set of known and predicted proteins previously compiled. In some embodiments, UBLAST or mmseqs2 may be used to search for similar proteins. In some embodiments, a search may be performed only for a representative subset of proteins in the family.

In some embodiments, the clusters of proteins within close proximity to CRISPR arrays are ranked or filtered by a metric to determine co-occurrence. One exemplary metric is the ratio of the number of elements in a protein cluster against the number of BLAST matches up to a certain E value threshold. In some embodiments, a constant E value threshold may be used. In other embodiments, the E value threshold may be determined by the most distant members of the protein cluster. In some embodiments, the global set of proteins is clustered and the co-occurrence metric is the ratio of the number of elements of the CRISPR associated cluster against the number of elements of the containing global cluster(s).

In some embodiments, a manual review process is used to evaluate the potential functionality and the minimal set of components of an engineered system based on the naturally occurring locus structure of the proteins in the cluster. In some embodiments, a graphical representation of the protein cluster may assist in the manual review, and may contain information including pairwise sequence similarity, phylogenetic tree, source organisms/environments, predicted functional domains, and a graphical depiction of locus structures. In some embodiments, the graphical depiction of locus structures may filter for nearby protein families that have a high representation. In some embodiments, representation may be calculated by the ratio of the number of related nearby proteins against the size(s) of the containing global cluster(s). In certain exemplary embodiments, the graphical representation of the protein cluster may contain a depiction of the CRISPR array structures of the naturally occurring loci. In some embodiments, the graphical representation of the protein cluster may contain a depiction of the number of conserved direct repeats versus the length of the putative CRISPR array, or the number of unique spacer sequences versus the length of the putative CRISPR array. In some embodiments, the graphical representation of the protein cluster may contain a depiction of various metrics of co-occurrence of the putative effector with CRISPR arrays predict new CRISPR-Cas systems and identify their components.

Pooled-Screening

To efficiently validate the activity of the engineered novel CRISPR-Cas systems and simultaneously evaluate in an unbiased manner different activity mechanisms and functional parameters, we used a new pooled-screening approach in *E. coli*. First, from the computational identification of the conserved protein and noncoding elements of the novel CRISPR-Cas system, DNA synthesis and molecular cloning was used to assemble the separate components into a single artificial expression vector, which in one embodiment is based on a pET-28a+ backbone. In a second embodiment, the effectors and noncoding elements are transcribed on a single mRNA transcript, and different ribosomal binding sites are used to translate individual effectors.

Second, the natural crRNA and targeting spacers were replaced with a library of unprocessed crRNAs containing non-natural spacers targeting the essential genes of the host *E. coli*, or a second plasmid encoding antibiotic resistance genes, pACYC184. This crRNA library was cloned into the vector backbone containing the protein effectors and noncoding elements (e.g. pET-28a+), and then subsequently transformed the library into *E. coli* along with the pACYC184 plasmid target. Consequently, each resulting *E. coli* cell contains no more than one targeting spacer. In an alternate embodiment, the library of unprocessed crRNAs containing non-natural spacers additionally target *E. coli* essential genes, drawn from resources such as those described in Baba et al. (2006) *Mol. Syst. Biol.* 2: 2006.0008 and Gerdes et al. (2003) *J. Bacteriol.* 185(19): 5673-84, each of which is incorporated herein by reference in its entirety. In this embodiment, positive, targeted activity of the novel CRISPR-Cas systems that disrupts essential gene function results in cell death or growth arrest. In some embodiments, the essential gene targeting spacers can be combined with the pACYC184 targets to add another dimension to the assay.

Third, the *E. coli* were grown under antibiotic selection. In one embodiment, triple antibiotic selection is used: kanamycin for ensuring successful transformation of the pET-28a+ vector containing the engineered CRISPR-Cas effector system, and chloramphenicol and tetracycline for ensuring successful co-transformation of the pACYC184 target vector. Since pACYC184 normally confers resistance to chloramphenicol and tetracycline, under antibiotic selection, positive activity of the novel CRISPR-Cas system targeting the plasmid will eliminate cells that actively express the effectors, noncoding elements, and specific active elements of the crRNA library. Examining the population of surviving cells at a later time point compared to an earlier time point results in a depleted signal compared to the inactive crRNAs. In some embodiments, double antibiotic selection is used. For example, withdrawal of either chloramphenicol or tetracycline to remove selective pressure can provide novel information about the targeting substrate, sequence specificity, and potency. In some embodiments, only kanamycin is used to ensure successful transformation of the pET-28a+ vector containing the engineered CRISPR-Cas effector system. This embodiment is suitable for libraries containing spacers targeting *E. coli* essential genes, as no additional selection beyond kanamycin is needed to observe growth alterations. In this embodiment, chloramphenicol and tetracycline dependence is removed, and their targets (if any) in the library provides an additional source of negative or positive information about the targeting substrate, sequence specificity, and potency.

Since the pACYC184 plasmid contains a diverse set of features and sequences that may affect the activity of a CRISPR-Cas system, mapping the active crRNAs from the pooled screen onto pACYC184 provides patterns of activity that can be suggestive of different activity mechanisms and functional parameters in a broad, hypothesis-agnostic manner. In this way, the features required for reconstituting the novel CRISPR-Cas system in a heterologous prokaryotic species can be more comprehensively tested and studied.

The key advantages of the in vivo pooled-screen described herein include:

(1) Versatility—Plasmid design allows multiple effectors and/or noncoding elements to be expressed; library cloning strategy enables both transcriptional directions of the computationally predicted crRNA to be expressed;

(2) Comprehensive tests of activity mechanisms and functional parameters—Evaluates diverse interference mechanisms, including DNA or RNA cleavage; examines co-occurrence of features such as transcription, plasmid DNA replication; and flanking sequences for crRNA library can be used to reliably determine PAMs with complexity equivalence of 4N's;

(3) Sensitivity—by targeting either the pACYC184 plasmid, which has a low copy number, or the single copy of the *E. coli* genome, this screen design enables high sensitivity for CRISPR-Cas activity since even modest interference rates can result in loss of cell viability through loss of antibiotic resistance or essential gene function; and (4) Efficiency—Optimized molecular biology steps to enable greater speed and throughput, because RNA-sequencing and protein expression samples can be directly harvested from the surviving cells in the screen.

The novel CRISPR-Cas families described herein were evaluated using this in vivo pooled-screen to evaluate their operational elements, mechanisms and parameters, as well as their ability to be active and reprogrammed in an engineered system outside of their natural cellular environment.

Class 2 CRISPR-Cas Effectors Having a RuvC Domain

In one aspect, the disclosure provides Class 2 CRISPR-Cas systems referred to herein as CLUST.018837. These Class 2 CRISPR-Cas systems contain an isolated CRISPR-associated protein having a RuvC domain.

In some embodiments, the CRISPR-associated protein and the RNA guide form a "binary" complex that may include other components. The binary complex is activated upon binding to a nucleic acid substrate that is complementary to a spacer sequence in the RNA guide (i.e., a sequence-specific substrate or target nucleic acid). In some embodiments, the sequence-specific substrate is a double-stranded DNA. In some embodiments, the sequence-specific substrate is a single-stranded DNA. In some embodiments, the sequence-specific substrate is a single-stranded RNA. In some embodiments, the sequence-specific substrate is a double-stranded RNA. In some embodiments, the sequence-specificity requires a complete match of the spacer sequence in the RNA guide (e.g., crRNA) to the target substrate. In other embodiments, the sequence specificity requires a partial (contiguous or non-contiguous) match of the spacer sequence in the RNA guide (e.g., crRNA) to the target substrate.

In some embodiments, the binary complex becomes activated upon binding to the target substrate. In some embodiments, the activated complex exhibits "multiple turnover" activity, whereby upon acting on (e.g., cleaving) the target substrate the activated complex remains in an activated state. In some embodiments, the activated binary complex exhibits "single turnover" activity, whereby upon acting on the target substrate the binary complex reverts to an inactive state. In some embodiments, the activated binary complex exhibits non-specific (i.e., "collateral") cleavage activity whereby the complex cleaves non-target nucleic acids. In some embodiments, the non-target nucleic acid is a DNA (e.g., a single-stranded or a double-stranded DNA). In some embodiments, the non-target nucleic acid is a RNA (e.g., a single-stranded or a double-stranded RNA).

CRISPR Enzyme Modifications

Deactivated/Inactivated/Nuclease dead CRISPR Enzymes

Where the CRISPR enzymes described herein have nuclease activity, the CRISPR enzymes can be modified to have diminished nuclease activity, e.g., nuclease inactivation of at least 50%, at least 60%, at least 70%, at least 80%, at least 90%, at least 95%, at least 97%, or 100% as compared with the wild type CRISPR enzymes. The nuclease activity can be diminished by several methods known in the art, e.g., introducing mutations into the nuclease domains of the proteins. In some embodiments, catalytic residues for the nuclease activities are identified, and these amino acid residues can be substituted by different amino acid residues (e.g., glycine or alanine) to diminish the nuclease activity.

Generation of Fusion Proteins

Additionally, nuclease dead CRISPR enzymes, whether in their native form or with mutations to modulate their nuclease activity, can provide a foundation from which fusion proteins with additional functional proteins can be created. The nuclease dead CRISPR enzymes can comprise or be associated (e.g., via fusion protein, linker peptides, and "GS" linkers ("GS" disclosed as SEQ ID NO: 1005)) with one or more functional domains. These functional domains can have various activities, e.g., methylase activity, demethylase activity, transcription activation activity, transcription repression activity, transcription release factor activity, histone modification activity, RNA cleavage activity, DNA cleavage activity, nucleic acid binding activity, and switch activity (e.g., light inducible). In some embodiments, the functional domains are Kruppel associated box (KRAB), VP64, VP16, FokI, P65, HSF1, MyoD1, and biotin-APEX.

The positioning of the one or more functional domains on the nuclease dead CRISPR enzymes is one that allows for correct spatial orientation for the functional domain to affect the target with the attributed functional effect. For example, if the functional domain is a transcription activator (e.g., VP16, VP64, or p65), the transcription activator is placed in a spatial orientation that allows it to affect the transcription of the target. Likewise, a transcription repressor is positioned to affect the transcription of the target, and a nuclease (e.g., FokI) is positioned to cleave or partially cleave the target. In some embodiments, the functional domain is positioned at the N-terminus of the CRISPR enzyme. In some embodiments, the functional domain is positioned at the C-terminus of the CRISPR enzyme. In some embodiments, the inactivated CRISPR enzyme is modified to comprise a first functional domain at the N-terminus and a second functional domain at the C-terminus.

The addition of functional domains to the CRISPR enzymes or onto other effector proteins in the complex may provide an ability for the CRISPR-Cas system to modify the physical DNA (e.g., methylation, etc.) or its regulation (e.g., transcriptional or repression) in situ.

Split Enzymes

The present disclosure also provides a split version of the CRISPR enzymes described herein. The split version of the CRISPR enzymes may be advantageous for delivery. In some embodiments, the CRISPR enzymes are split to two parts of the enzymes, which together substantially comprises a functioning CRISPR enzyme.

The split can be done in a way that the catalytic domain(s) are unaffected. The CRISPR enzymes may function as a nuclease or may be inactivated enzymes, which are essentially RNA-binding proteins with very little or no catalytic activity (e.g., due to mutation(s) in its catalytic domains).

In some embodiments, the nuclease lobe and α-helical lobe are expressed as separate polypeptides. Although the lobes do not interact on their own, the RNA guide recruits them into a ternary complex that recapitulates the activity of full-length CRISPR enzymes and catalyzes site-specific DNA cleavage. The use of a modified RNA guide abrogates split-enzyme activity by preventing dimerization, allowing for the development of an inducible dimerization system. The split enzyme is described, e.g., in Wright, Addison V., et al. "Rational design of a split-Cas9 enzyme complex," Proc. Nat'l. Acad. Sci., 112.10 (2015): 2984-2989, which is incorporated herein by reference in its entirety.

In some embodiments, the split enzyme can be fused to a dimerization partner, e.g., by employing rapamycin sensitive dimerization domains. This allows the generation of a chemically inducible CRISPR enzyme for temporal control of CRISPR enzyme activity. The CRISPR enzymes can thus be rendered chemically inducible by being split into two fragments and rapamycin-sensitive dimerization domains can be used for controlled reassembly of the CRISPR enzymes.

The split point is typically designed in silico and cloned into the constructs. During this process, mutations can be introduced to the split enzyme and non-functional domains can be removed. In some embodiments, the two parts or fragments of the split CRISPR enzyme (i.e., the N-terminal and C-terminal fragments), can form a full CRISPR enzyme, comprising, e.g., at least 70%, at least 80%, at least 90%, at least 95%, or at least 99% of the sequence of the wild-type CRISPR enzyme.

Self-Activating or Inactivating Enzymes

The CRISPR enzymes described herein can be designed to be self-activating or self-inactivating. In some embodiments, the CRISPR enzymes are self-inactivating. For example, the target sequence can be introduced into the CRISPR enzyme coding constructs. Thus, the CRISPR enzymes can modify, e.g., cleave, the target sequence, as well as the construct encoding the enzyme thereby self-inactivating their expression. Methods of constructing a self-inactivating CRISPR-Cas system is described, e.g., in Epstein, Benjamin E., and David V. Schaffer. "Engineering a Self-Inactivating CRISPR-Cas System for AAV Vectors," Mol. Ther., 24 (2016): S50, which is incorporated herein by reference in its entirety.

In some other embodiments, an additional RNA guide, expressed under the control of a weak promoter (e.g., 7SK promoter), can target the nucleic acid sequence encoding the CRISPR enzyme to prevent and/or block its expression (e.g., by preventing the transcription and/or translation of the nucleic acid). The transfection of cells with vectors expressing the CRISPR enzyme, and RNA guides that target the nucleic acid encoding the CRISPR enzyme can lead to efficient disruption of the nucleic acid encoding the CRISPR enzyme and decrease the levels of CRISPR enzyme, thereby limiting the genome editing activity.

In some embodiments, the genome editing activity of the CRISPR enzymes can be modulated through endogenous RNA signatures (e.g., miRNA) in mammalian cells. The CRISPR enzyme switch can be made by using a miRNA-complementary sequence in the 5'-UTR of mRNA encoding the CRISPR enzyme. The switches selectively and efficiently respond to miRNA in the target cells. Thus, the switches can differentially control the genome editing by sensing endogenous miRNA activities within a heterogeneous cell population. Therefore, the switch systems can provide a framework for cell-type selective genome editing and cell engineering based on intracellular miRNA information (Hirosawa, Moe et al. "Cell-type-specific genome editing with a microRNA-responsive CRISPR-Cas9 switch," Nucl. Acids Res., 2017 Jul. 27; 45(13): e118).

Inducible CRISPR Enzymes

The CRISPR enzymes can be inducible, e.g., light inducible or chemically inducible. This mechanism allows for activation of the functional domain in the CRISPR enzymes. Light inducibility can be achieved by various methods known in the art, e.g., by designing a fusion complex wherein CRY2 PHR/CIBN pairing is used in split CRISPR Enzymes (see, e.g., Konermann et al. "Optical control of mammalian endogenous transcription and epigenetic states," *Nature*, 500.7463 (2013): 472). Chemical inducibility can be achieved, e.g., by designing a fusion complex wherein FKBP/FRB (FK506 binding protein/FKBP rapamycin binding domain) pairing is used in split CRISPR Enzymes. Rapamycin is required for forming the fusion complex, thereby activating the CRISPR enzymes (see, e.g., Zetsche, Volz, and Zhang, "A split-Cas9 architecture for inducible genome editing and transcription modulation," *Nature Biotech.*, 33.2 (2015): 139-142).

Furthermore, expression of the CRISPR enzymes can be modulated by inducible promoters, e.g., tetracycline or doxycycline controlled transcriptional activation (Tet-On and Tet-Off expression system), hormone inducible gene expression system (e.g., an ecdysone inducible gene expression system), and an arabinose-inducible gene expression system. When delivered as RNA, expression of the RNA targeting effector protein can be modulated via a riboswitch, which can sense a small molecule like tetracycline (see, e.g., Goldfless, Stephen J. et al. "Direct and specific chemical control of eukaryotic translation with a synthetic RNA-protein interaction," *Nucl. Acids Res.*, 40.9 (2012): e64-e64).

Various embodiments of inducible CRISPR enzymes and inducible CRISPR-Cas systems are described, e.g., in U.S. Pat. No. 8,871,445, US20160208243, and WO2016205764, each of which is incorporated herein by reference in its entirety.

Functional Mutations

Various mutations or modifications can be introduced into CRISPR enzymes as described herein to improve specificity and/or robustness. In some embodiments, the amino acid residues that recognize the Protospacer Adjacent Motif (PAM) are identified. The CRISPR enzymes described herein can be modified further to recognize different PAMs, e.g., by substituting the amino acid residues that recognize PAM with other amino acid residues. In some embodiments, the CRISPR enzymes can recognize a PAM, e.g., 5'-TTN-3' or 5'-YTN-3', wherein N is any nucleobase and Y is cytosine or thymine.

In some embodiments, at least one Nuclear Localization Signal (NLS) is attached to the nucleic acid sequences encoding the CRISPR enzyme. In some embodiments, at least one Nuclear Export Signal (NES) is attached to the nucleic acid sequences encoding the CRISPR enzyme. In a preferred embodiment a C-terminal and/or N-terminal NLS or NES is attached for optimal expression and nuclear targeting in eukaryotic cells, e.g., human cells.

In some embodiments, the CRISPR enzymes described herein are mutated at one or more amino acid residues to alter one or more functional activities. For example, in some embodiments, the CRISPR enzyme is mutated at one or more amino acid residues to alter its helicase activity. In some embodiments, the CRISPR enzyme is mutated at one or more amino acid residues to alter its nuclease activity (e.g., endonuclease activity or exonuclease activity). In some embodiments, the CRISPR enzyme is mutated at one or more amino acid residues to alter its ability to functionally associate with a RNA guide. In some embodiments, the CRISPR enzyme is mutated at one or more amino acid residues to alter its ability to functionally associate with a target nucleic acid.

In some embodiments, the CRISPR enzymes described herein are capable of binding to or modifying a target nucleic acid molecule. In some embodiments, the CRISPR enzyme modifies both strands of the target nucleic acid molecule. However, in some embodiments, the CRISPR enzyme is mutated at one or more amino acid residues to alter its nucleic acid manipulation activity. For example, in some embodiments, the CRISPR enzyme may comprise one or more mutations which render the enzyme incapable of cleaving a target nucleic acid. In other embodiments, the CRISPR enzyme may comprise one or more mutations such that the enzyme is capable of cleaving a single strand of the target nucleic acid (i.e., nickase activity). In some embodiments, the CRISPR enzyme is capable of cleaving the strand of the target nucleic acid that is complementary to the strand to which the RNA guide hybridizes. In some embodiments, the CRISPR enzyme is capable of cleaving the strand of the target nucleic acid to which the RNA guide hybridizes.

In some embodiments, a CRISPR enzyme described herein may be engineered to comprise a deletion in one or more amino acid residues to reduce the size of the enzyme while retaining one or more desired functional activities (e.g., nuclease activity and the ability to interact functionally with a RNA guide). The truncated CRISPR enzyme may be advantageously used in combination with delivery systems having load limitations.

Nucleic Acids Encoding the CRISPR-Associated Proteins

Nucleic acids encoding the proteins (e.g., a CRISPR-associated protein) and RNA guides (e.g., a crRNA) described herein are also provided. In some embodiments, the nucleic acid is a synthetic nucleic acid. In some embodiments, the nucleic acid is a DNA molecule. In some embodiments, the nucleic acid is an RNA molecule (e.g., an mRNA molecule). In some embodiments, the nucleic acid is an mRNA. In some embodiments, the mRNA is capped, polyadenylated, substituted with 5-methylcytidine, substituted with pseudouridine, or a combination thereof. In some embodiments, the nucleic acid (e.g., DNA) is operably-linked to a regulatory element (e.g., a promoter) to control the expression of the nucleic acid. In some embodiments, the promoter is a constitutive promoter. In some embodiments, the promoter is an inducible promoter. In some embodiments, the promoter is a cell-specific promoter. In some embodiments, the promoter is an organism-specific promoter. Suitable promoters are known in the art and include, for example, a pol I promoter, a pol II promoter, a pol III promoter, a T7 promoter, a U6 promoter, a H1 promoter, retroviral Rous sarcoma virus LTR promoter, a cytomegalovirus (CMV) promoter, a SV40 promoter, a dihydrofolate reductase promoter, and a β-actin promoter. For example, a U6 promoter can be used to regulate the expression of an RNA guide molecule described herein.

In some embodiments, the nucleic acids are modified, e.g., optimized, e.g., codon-optimized, for expression in a eukaryotic cell, e.g., a mammalian cell, such as a human cell.

In some embodiments, the nucleic acid(s) are present in a vector (e.g., a viral vector or a phage). The vectors can include one or more regulatory elements that allow for the propagation of the vector in a cell of interest (e.g., a bacterial cell or a mammalian cell). In some embodiments, the vector includes a nucleic acid encoding a single component of a CRISPR-associated (Cas) system described herein. In some embodiments, the vector includes multiple nucleic acids, each encoding a component of a CRISPR-associated (Cas) system described herein.

In one aspect, the present disclosure provides nucleic acid sequences that are at least 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% identical to the nucleic sequences described herein. In another aspect, the present disclosure also provides amino acid sequences that are at least 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% identical to the amino acid sequences described herein.

In some embodiments, the nucleic acid sequences have at least a portion (e.g., at least 1, 2, 3, 4, 5, 6, 7, 8, 9, 10, 11, 12, 13, 14, 15, 20, 30, 40, 50, 60, 70, 80, 90, or 100 nucleotides, e.g., contiguous or non-contiguous nucleotides) that are the same as the sequences described herein. In some embodiments, the nucleic acid sequences have at least a portion (e.g., at least 1, 2, 3, 4, 5, 6, 7, 8, 9, 10, 11, 12, 13, 14, 15, 20, 30, 40, 50, 60, 70, 80, 90, or 100 nucleotides, e.g., contiguous or non-contiguous nucleotides) that is different from the sequences described herein.

In some embodiments, the amino acid sequences have at least a portion (e.g., at least 1, 2, 3, 4, 5, 6, 7, 8, 9, 10, 11, 12, 13, 14, 15, 20, 30, 40, 50, 60, 70, 80, 90, or 100 amino acid residues, e.g., contiguous or non-contiguous amino acid residues) that is the same as the sequences described herein. In some embodiments, the amino acid sequences have at least a portion (e.g., at least 1, 2, 3, 4, 5, 6, 7, 8, 9, 10, 11, 12, 13, 14, 15, 20, 30, 40, 50, 60, 70, 80, 90, or 100 amino acid residues, e.g., contiguous or non-contiguous amino acid residues) that is different from the sequences described herein.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In general, the length of a reference sequence aligned for comparison purposes should be at least 80% of the length of the reference sequence, and in some embodiments is at least 90%, 95%, or 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences. For purposes of the present disclosure, the comparison of sequences and determination of percent identity between two sequences can be accomplished using a Blosum 62 scoring matrix with a gap penalty of 12, a gap extend penalty of 4, and a frameshift gap penalty of 5.

RNA Guide Modifications

Spacer Lengths

The spacer length of RNA guides can range from about 15 to 50 nucleotides. In some embodiments, the spacer length of a RNA guide is at least 16 nucleotides, at least 17 nucleotides, at least 18 nucleotides, at least 19 nucleotides, at least 20 nucleotides, at least 21 nucleotides, or at least 22 nucleotides. In some embodiments, the spacer length is from 15 to 17 nucleotides, from 15 to 23 nucleotides, from 16 to 22 nucleotides, from 17 to 20 nucleotides, from 20 to 24 nucleotides (e.g., 20, 21, 22, 23, or 24 nucleotides), from 23 to 25 nucleotides (e.g., 23, 24, or 25 nucleotides), from 24 to 27 nucleotides, from 27 to 30 nucleotides, from 30 to 45 nucleotides (e.g., 30, 31, 32, 33, 34, 35, 40, or 45 nucleotides), from 30 or 35 to 40 nucleotides, from 41 to 45 nucleotides, from 45 to 50 nucleotides, or longer. In some embodiments, the direct repeat length of the RNA guide is at least 16 nucleotides, or is from 16 to 20 nucleotides (e.g., 16, 17, 18, 19, or 20 nucleotides). In some embodiments, the direct repeat length of the RNA guide is 19 nucleotides.

Exemplary RNA guide direct repeat sequences and effector protein pairs are provided in Table 3. In some embodiments, the RNA guide includes a direct repeat sequence comprising or consisting of a nucleic acid sequence listed in Table 3 (e.g., SEQ ID Nos: 27-47, 263-440).

The RNA guide sequences can be modified in a manner that allows for formation of the CRISPR complex and successful binding to the target, while at the same time not allowing for successful effector activity (i.e., without nuclease activity/without causing indels). These modified guide sequences are referred to as "dead guides" or "dead guide sequences." These dead guides or dead guide sequences may be catalytically inactive or conformationally inactive with regard to nuclease activity. Dead guide sequences are typically shorter than respective guide sequences that result in active DNA modification. In some embodiments, dead guides are 5%, 10%, 20%, 30%, 40%, or 50%, shorter than respective RNA guides that have nuclease activity. Dead guide sequences of RNA guides can be from 13 to 15 nucleotides in length (e.g., 13, 14, or 15 nucleotides in length), from 15 to 19 nucleotides in length, or from 17 to 18 nucleotides in length (e.g., 17 nucleotides in length).

Thus, in one aspect, the disclosure provides non-naturally occurring or engineered CRISPR-Cas systems including a functional CRISPR enzyme as described herein, and a RNA guide wherein the RNA guide includes a dead guide sequence whereby the RNA guide is capable of hybridizing to a target sequence such that the CRISPR-Cas system is directed to a genomic locus of interest in a cell without detectable nucleic acid modification activity.

A detailed description of dead guides is described, e.g., in WO 2016094872, which is incorporated herein by reference in its entirety.

Inducible Guides

RNA guides can be generated as components of inducible systems. The inducible nature of the systems allows for spatiotemporal control of gene editing or gene expression. In some embodiments, the stimuli for the inducible systems include, e.g., electromagnetic radiation, sound energy, chemical energy, and/or thermal energy.

In some embodiments, the transcription of RNA guides can be modulated by inducible promoters, e.g., tetracycline or doxycycline controlled transcriptional activation (Tet-On and Tet-Off expression systems), hormone inducible gene expression systems (e.g., ecdysone inducible gene expression systems), and arabinose-inducible gene expression systems. Other examples of inducible systems include, e.g., small molecule two-hybrid transcription activations systems (FKBP, ABA, etc.), light inducible systems (Phytochrome, LOV domains, or cryptochrome), or Light Inducible Transcriptional Effector (LITE). These inducible systems are described, e.g., in WO 2016205764 and U.S. Pat. No. 8,795,965, both of which are incorporated herein by reference in their entirety.

Chemical Modifications

Chemical modifications can be applied to the RNA guide's phosphate backbone, sugar, and/or base. Backbone modifications such as phosphorothioates modify the charge on the phosphate backbone and aid in the delivery and nuclease resistance of the oligonucleotide (see, e.g., Eckstein, "Phosphorothioates, essential components of therapeutic oligonucleotides," Nucl. Acid Ther., 24 (2014), pp. 374-387); modifications of sugars, such as 2'-O-methyl (2'-OMe), 2'-F, and locked nucleic acid (LNA), enhance both base pairing and nuclease resistance (see, e.g., Allerson et al. "Fully 2'-modified oligonucleotide duplexes with improved in vitro potency and stability compared to unmodified small interfering RNA," J. Med. Chem., 48.4 (2005): 901-904). Chemically modified bases such as 2-thiouridine or N6-methyladenosine, among others, can allow for either stronger or weaker base pairing (see, e.g., Bramsen et al., "Development of therapeutic-grade small interfering RNAs by chemical engineering," Front. Genet., 2012 Aug. 20; 3:154). Additionally, RNA is amenable to both 5' and 3' end conjugations with a variety of functional moieties including fluorescent dyes, polyethylene glycol, or proteins.

A wide variety of modifications can be applied to chemically synthesized RNA guide molecules. For example, modifying an oligonucleotide with a 2'-OMe to improve nuclease resistance can change the binding energy of Watson-Crick base pairing. Furthermore, a 2'-OMe modification can affect how the oligonucleotide interacts with transfection reagents, proteins or any other molecules in the cell. The effects of these modifications can be determined by empirical testing.

In some embodiments, the RNA guide includes one or more phosphorothioate modifications. In some embodiments, the RNA guide includes one or more locked nucleic acids for the purpose of enhancing base pairing and/or increasing nuclease resistance.

A summary of these chemical modifications can be found, e.g., in Kelley et al., "Versatility of chemically synthesized guide RNAs for CRISPR-Cas9 genome editing," J. Biotechnol. 2016 Sep. 10; 233:74-83; WO 2016205764; and U.S. Pat. No. 8,795,965 B2; each which is incorporated by reference in its entirety.

Sequence Modifications

The sequences and the lengths of the RNA guides described herein can be optimized. In some embodiments, the optimized length of RNA guide can be determined by identifying the processed form of tracrRNA and/or crRNA, or by empirical length studies for guide RNAs, tracrRNAs, crRNAs, and the tracrRNA tetraloops.

The RNA guides can also include one or more aptamer sequences. Aptamers are oligonucleotide or peptide molecules that can bind to a specific target molecule. The aptamers can be specific to gene effectors, gene activators, or gene repressors. In some embodiments, the aptamers can be specific to a protein, which in turn is specific to and recruits/binds to specific gene effectors, gene activators, or gene repressors. The effectors, activators, or repressors can be present in the form of fusion proteins. In some embodiments, the RNA guide has two or more aptamer sequences that are specific to the same adaptor proteins. In some embodiments, the two or more aptamer sequences are specific to different adaptor proteins. The adaptor proteins can include, e.g., MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, and PRR1. Accordingly, in some embodiments, the aptamer is selected from binding proteins specifically binding any one of the adaptor proteins as described herein. In some embodiments, the aptamer sequence is a MS2 loop. A detailed description of aptamers can be found, e.g., in Nowak et al., "Guide RNA engineering for versatile Cas9 functionality," *Nucl. Acid. Res.,* 2016 Nov. 16; 44(20):9555-9564; and WO 2016205764, which are incorporated herein by reference in their entirety.

Guide: Target Sequence Matching Requirements

In classic CRISPR-Cas systems, the degree of complementarity between a guide sequence and its corresponding target sequence can be about 50%, 60%, 75%, 80%, 85%, 90%, 95%, 97.5%, 99%, or 100%. In some embodiments, the degree of complementarity is 100%. The RNA guides can be about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length.

To reduce off-target interactions, e.g., to reduce the guide interacting with a target sequence having low complementarity, mutations can be introduced to the CRISPR-Cas systems so that the CRISPR-Cas systems can distinguish between target and off-target sequences that have greater than 80%, 85%, 90%, or 95% complementarity. In some embodiments, the degree of complementarity is from 80% to 95%, e.g., about 83%, 84%, 85%, 86%, 87%, 88%, 89%, 90%, 91%, 92%, 93%, 94%, or 95% (for example, distinguishing between a target having 18 nucleotides from an off-target of 18 nucleotides having 1, 2, or 3 mismatches). Accordingly, in some embodiments, the degree of complementarity between a guide sequence and its corresponding target sequence is greater than 94.5%, 95%, 95.5%, 96%, 96.5%, 97%, 97.5%, 98%, 98.5%, 99%, 99.5%, or 99.9%. In some embodiments, the degree of complementarity is 100%.

It is known in the field that complete complementarity is not required provided that there is sufficient complementarity to be functional. For CRISPR nucleases, modulation of cleavage efficiency can be exploited by introduction of mismatches, e.g., one or more mismatches, such as 1 or 2 mismatches between spacer sequence and target sequence, including the position of the mismatch along the spacer/target. The more central (i.e., not at the 3' or 5' ends) a mismatch, e.g., a double mismatch, is located; the more cleavage efficiency is affected. Accordingly, by choosing mismatch positions along the spacer sequence, cleavage efficiency can be modulated. For example, if less than 100% cleavage of targets is desired (e.g., in a cell population), 1 or 2 mismatches between spacer and target sequence can be introduced in the spacer sequences.

Methods of Using CRISPR-Cas Systems

The CRISPR-Cas systems described herein have a wide variety of utilities including modifying (e.g., deleting, inserting, translocating, inactivating, or activating) a target polynucleotide in a multiplicity of cell types. The CRISPR-Cas systems have a broad spectrum of applications in, e.g., DNA/RNA detection (e.g., specific high sensitivity enzymatic reporter unlocking (SHERLOCK)), tracking and labeling of nucleic acids, enrichment assays (extracting desired sequence from background), detecting circulating tumor DNA, preparing next generation library, drug screening, disease diagnosis and prognosis, and treating various genetic diseases or disorders, and treating various non-genetic diseases or disorders, or augmenting health via manipulation of the genome.

DNA/RNA Detection

In one aspect, the CRISPR-Cas systems described herein can be used in DNA/RNA detection. Single effector RNA-guided DNases can be reprogrammed with CRISPR RNAs (crRNAs) to provide a platform for specific single-stranded DNA (ssDNA) sensing. Upon recognition of its DNA target, activated Type V single effector DNA-guided DNases engage in "collateral" cleavage of nearby non-targeted ssDNAs. This crRNA-programmed collateral cleavage activity allows the CRISPR-Cas systems to detect the presence of a specific DNA by nonspecific degradation of labeled ssDNA.

The collateral ssDNA activity can be combined with a reporter in DNA detection applications such as a method called the DNA Endonuclease-Targeted CRISPR trans reporter (DETECTR) method, which achieves attomolar sensitivity for DNA detection (see, e.g., Chen et al., Science, 360(6387):436-439, 2018), which is incorporated herein by reference in its entirety. One application of using the enzymes described herein is to degrade non-specific ssDNA in an in vitro environment. A "reporter" ssDNA molecule linking a fluorophore and a quencher can also be added to the in vitro system, along with an unknown sample of DNA (either single-stranded or double-stranded). Upon recognizing the target sequence in the unknown piece of DNA, the effector complex cleaves the reporter ssDNA resulting in a fluorescent readout.

In other embodiments, the SHERLOCK method (Specific High Sensitivity Enzymatic Reporter UnLOCKing) also provides an in vitro nucleic acid detection platform with attomolar (or single-molecule) sensitivity based on nucleic acid amplification and collateral cleavage of a reporter ssDNA, allowing for real-time detection of the target. Methods of using CRISPR in SHERLOCK are described in detail, e.g., in Gootenberg, et al. "Nucleic acid detection with CRISPR-Cas13a/C2c2," *Science,* 356(6336):438-442 (2017), which is incorporated herein by reference in its entirety.

In some embodiments, the CRISPR-Cas systems described herein can be used in multiplexed error-robust fluorescence in situ hybridization (MERFISH). These methods are described in, e.g., Chen et al., "Spatially resolved, highly multiplexed RNA profiling in single cells," Science, 2015 Apr. 24; 348(6233):aaa6090, which is incorporated herein by reference in its entirety.

Tracking and Labeling of Nucleic Acids

Cellular processes depend on a network of molecular interactions among proteins, RNAs, and DNAs. Accurate detection of protein-DNA and protein-RNA interactions is key to understanding such processes. In vitro proximity labeling techniques employ an affinity tag combined with, a reporter group, e.g., a photoactivatable group, to label polypeptides and RNAs in the vicinity of a protein or RNA of interest in vitro. After UV irradiation, the photoactivatable groups react with proteins and other molecules that are in close proximity to the tagged molecules, thereby labelling them. Labelled interacting molecules can subsequently be recovered and identified. The RNA targeting effector proteins can for instance be used to target probes to selected RNA sequences. These applications can also be applied in animal models for in vivo imaging of diseases or difficult-to culture cell types. The methods of tracking and labeling of nucleic acids are described, e.g., in U.S. Pat. No. 8,795,965; WO 2016205764; and WO 2017070605; each of which is incorporated herein by reference in its entirety.

High-Throughput Screening

The CRISPR-Cas systems described herein can be used for preparing next generation sequencing (NGS) libraries. For example, to create a cost-effective NGS library, the CRISPR-Cas systems can be used to disrupt the coding sequence of a target gene, and the CRISPR enzyme transfected clones can be screened simultaneously by next-generation sequencing (e.g., on an Illumina system). A detailed description regarding how to prepare NGS libraries can be found, e.g., in Bell et al., "A high-throughput screening strategy for detecting CRISPR-Cas9 induced mutations using next-generation sequencing," *BMC Genomics*, 15.1 (2014): 1002, which is incorporated herein by reference in its entirety.

Engineered Microorganisms

Microorganisms (e.g., *E. coli*, yeast, and microalgae) are widely used for synthetic biology. The development of synthetic biology has a wide utility, including various clinical applications. For example, the programmable CRISPR-Cas systems can be used to split proteins of toxic domains for targeted cell death, e.g., using cancer-linked RNA as target transcript. Further, pathways involving protein-protein interactions can be influenced in synthetic biological systems with e.g. fusion complexes with the appropriate effectors such as kinases or enzymes.

In some embodiments, RNA guide sequences that target phage sequences can be introduced into the microorganism. Thus, the disclosure also provides methods of vaccinating a microorganism (e.g., a production strain) against phage infection.

In some embodiments, the CRISPR-Cas systems provided herein can be used to engineer microorganisms, e.g., to improve yield or improve fermentation efficiency. For example, the CRISPR-Cas systems described herein can be used to engineer microorganisms, such as yeast, to generate biofuel or biopolymers from fermentable sugars, or to degrade plant-derived lignocellulose derived from agricultural waste as a source of fermentable sugars. More particularly, the methods described herein can be used to modify the expression of endogenous genes required for biofuel production and/or to modify endogenous genes, which may interfere with the biofuel synthesis. These methods of engineering microorganisms are described e.g., in Verwaal et al., "CRISPR/Cpf1 enables fast and simple genome editing of *Saccharomyces cerevisiae*," *Yeast*, 2017 Sep. 8. doi: 10.1002/yea.3278; and Hlavova et al., "Improving microalgae for biotechnology—from genetics to synthetic biology," Biotechnol. Adv., 2015 Nov. 1; 33:1194-203, both of which are incorporated herein by reference in their entirety.

Application in Plants

The CRISPR-Cas systems described herein have a wide variety of utility in plants. In some embodiments, the CRISPR-Cas systems can be used to engineer genomes of plants (e.g., improving production, making products with desired post-translational modifications, or introducing genes for producing industrial products). In some embodiments, the CRISPR-Cas systems can be used to introduce a desired trait to a plant (e.g., with or without heritable modifications to the genome), or regulate expression of endogenous genes in plant cells or whole plants.

In some embodiments, the CRISPR-Cas systems can be used to identify, edit, and/or silence genes encoding specific proteins, e.g., allergenic proteins (e.g., allergenic proteins in peanuts, soybeans, lentils, peas, green beans, and mung beans). A detailed description regarding how to identify, edit, and/or silence genes encoding proteins is described, e.g., in Nicolaou et al., "Molecular diagnosis of peanut and legume allergy," *Curr. Opin. Allergy Clin. Immunol.*, 11(3): 222-8 (2011), and WO 2016205764 A1; both of which are incorporated herein by reference in their entirety.

Gene Drives

Gene drive is the phenomenon in which the inheritance of a particular gene or set of genes is favorably biased. The CRISPR-Cas systems described herein can be used to build gene drives. For example, the CRISPR-Cas systems can be designed to target and disrupt a particular allele of a gene, causing the cell to copy the second allele to fix the sequence. Because of the copying, the first allele will be converted to the second allele, increasing the chance of the second allele being transmitted to the offspring. A detailed method regarding how to use the CRISPR-Cas systems described herein to build gene drives is described, e.g., in Hammond et al., "A CRISPR-Cas9 gene drive system targeting female reproduction in the malaria mosquito vector *Anopheles gambiae*," *Nat. Biotechnol.*, 2016 January; 34(1):78-83, which is incorporated herein by reference in its entirety.

Pooled-Screening

As described herein, pooled CRISPR screening is a powerful tool for identifying genes involved in biological mechanisms such as cell proliferation, drug resistance, and viral infection. Cells are transduced in bulk with a library of RNA guide-encoding vectors described herein, and the distribution of RNA guides is measured before and after applying a selective challenge. Pooled CRISPR screens work well for mechanisms that affect cell survival and proliferation, and they can be extended to measure the activity of individual genes (e.g., by using engineered reporter cell lines). Arrayed CRISPR screens, in which only one gene is targeted at a time, make it possible to use RNA-seq as the readout. In some embodiments, the CRISPR-Cas systems as described herein can be used in single-cell CRISPR screens. A detailed description regarding pooled CRISPR screenings can be found, e.g., in Datlinger et al., "Pooled CRISPR screening with single-cell transcriptome read-out," *Nat. Methods.*, 2017 March; 14(3): 297-301, which is incorporated herein by reference in its entirety.

Saturation Mutagenesis ("Bashing")

The CRISPR-Cas systems described herein can be used for in situ saturating mutagenesis. In some embodiments, a pooled RNA guide library can be used to perform in situ saturating mutagenesis for particular genes or regulatory elements. Such methods can reveal critical minimal features and discrete vulnerabilities of these genes or regulatory elements (e.g., enhancers). These methods are described, e.g., in Canver et al., "BCL11A enhancer dissection by Cas9-mediated in situ saturating mutagenesis," *Nature*, 2015 Nov. 12; 527(7577):192-7, which is incorporated herein by reference in its entirety.

Quantitative Trait Mapping (crisprQTL)

The CRISPR-Cas systems described herein can be used for mapping coding and non-coding regions of a genome that influence gene expression. For example, in some embodiments, a population of cells may be transduced with multiple random, barcoded, CRISPR guide RNA-programmed perturbations in each cell. Single-cell RNA-sequencing may then be used to profile gene expression and the collection of RNA guides in each cell. The generated data can then be used to identify associations between RNA guides and quantitative changes in gene expression, which facilitates the analysis of the cis-regulatory architecture of the cells. These methods are described, for example, in Gasperini et al., "crisprQTL mapping as a genome-wide association framework for cellular genetic screens," bioRxiv 314344, posted May 4, 2018, doi: doi.org/10.1101/314344, which is incorporated herein by reference in its entirety.

Therapeutic Applications

The CRISPR-Cas systems described herein can have various therapeutic applications. In some embodiments, the new CRISPR-Cas systems can be used to treat various diseases and disorders, e.g., genetic disorders (e.g., monogenetic diseases), diseases that can be treated by nuclease activity (e.g., Pcsk9 targeting, Duchenne Muscular Dystrophy (DMD), BCL11a targeting), and various cancers, etc.

In some embodiments, the CRISPR-Cas systems described herein can be used to edit a target nucleic acid to modify the target nucleic acid (e.g., by inserting, deleting, or mutating one or more amino acid residues). For example, in some embodiments the CRISPR-Cas systems described herein comprise an exogenous donor template nucleic acid (e.g., a DNA molecule or an RNA molecule), which comprises a desirable nucleic acid sequence. Upon resolution of a cleavage event induced with the CRISPR-Cas system described herein, the molecular machinery of the cell utilizes the exogenous donor template nucleic acid in repairing and/or resolving the cleavage event. Alternatively, the molecular machinery of the cell can utilize an endogenous template in repairing and/or resolving the cleavage event. In some embodiments, the CRISPR-Cas systems described herein may be used to alter a target nucleic acid resulting in an insertion, a deletion, and/or a point mutation). In some embodiments, the insertion is a scarless insertion (i.e., the insertion of an intended nucleic acid sequence into a target nucleic acid resulting in no additional unintended nucleic acid sequence upon resolution of the cleavage event). Donor template nucleic acids may be double stranded or single stranded nucleic acid molecules (e.g., DNA or RNA). Methods of designing exogenous donor template nucleic acids are described, for example, in PCT Publication No. WO 2016094874 A1, the entire contents of which are expressly incorporated herein by reference.

In one aspect, the CRISPR-Cas systems described herein can be used for treating a disease caused by overexpression of RNAs, toxic RNAs, and/or mutated RNAs (e.g., splicing defects or truncations). For example, expression of the toxic RNAs may be associated with the formation of nuclear inclusions and late-onset degenerative changes in brain, heart, or skeletal muscle. In some embodiments, the disorder is myotonic dystrophy. In myotonic dystrophy, the main pathogenic effect of the toxic RNAs is to sequester binding proteins and compromise the regulation of alternative splicing (see, e.g., Osborne et al., "RNA-dominant diseases," Hum. Mol. Genet., 2009 Apr. 15; 18(8):1471-81). Myotonic dystrophy (dystrophia myotonica (DM)) is of particular interest to geneticists because it produces an extremely wide range of clinical features. The classical form of DM, which is now called DM type 1 (DM1), is caused by an expansion of CTG repeats in the 3'-untranslated region (UTR) of DMPK, a gene encoding a cytosolic protein kinase. The CRISPR-Cas systems as described herein can target overexpressed RNA or toxic RNA, e.g., the DMPK gene or any of the mis-regulated alternative splicing in DM1 skeletal muscle, heart, or brain.

The CRISPR-Cas systems described herein can also target trans-acting mutations affecting RNA-dependent functions that cause various diseases such as, e.g., Prader Willi syndrome, Spinal muscular atrophy (SMA), and Dyskeratosis congenita. A list of diseases that can be treated using the CRISPR-Cas systems described herein is summarized in Cooper et al., "RNA and disease," Cell, 136.4 (2009): 777-793, and WO 2016205764 A1, both of which are incorporated herein by reference in their entirety. Those of skill in this field will understand how to use the new CRISPR-Cas systems to treat these diseases.

The CRISPR-Cas systems described herein can also be used in the treatment of various tauopathies, including, e.g., primary and secondary tauopathies, such as primary age-related tauopathy (PART)/Neurofibrillary tangle (NFT)-predominant senile dementia (with NFTs similar to those seen in Alzheimer Disease (AD), but without plaques), dementia pugilistica (chronic traumatic encephalopathy), and progressive supranuclear palsy. A useful list of tauopathies and methods of treating these diseases are described, e.g., in WO 2016205764, which is incorporated herein by reference in its entirety.

The CRISPR-Cas systems described herein can also be used to target mutations disrupting the cis-acting splicing codes that can cause splicing defects and diseases. These diseases include, e.g., motor neuron degenerative disease that results from deletion of the SMN1 gene (e.g., spinal muscular atrophy), Duchenne Muscular Dystrophy (DMD), frontotemporal dementia, and Parkinsonism linked to chromosome 17 (FTDP-17), and cystic fibrosis.

The CRISPR-Cas systems described herein can further be used for antiviral activity, in particular against RNA viruses. The effector proteins can target the viral RNAs using suitable RNA guides selected to target viral RNA sequences.

Furthermore, in vitro RNA sensing assays can be used to detect specific RNA substrates. The RNA targeting effector proteins can be used for RNA-based sensing in living cells. Examples of applications are diagnostics by sensing of, for examples, disease-specific RNAs.

A detailed description of therapeutic applications of the CRISPR-Cas systems described herein can be found, e.g., in U.S. Pat. No. 8,795,965, EP 3009511, WO 2016205764, and WO 2017070605; each of which is incorporated herein by reference in its entirety.

Delivery of CRISPR-Cas Systems

Through this disclosure and the knowledge in the art, the CRISPR-Cas systems described herein, or components thereof, nucleic acid molecules thereof, or nucleic acid molecules encoding or providing components thereof, can be delivered by various delivery systems such as vectors, e.g., plasmids, viral delivery vectors. The new CRISPR enzymes and/or any of the RNAs (e.g., RNA guides) can be delivered using suitable vectors, e.g., plasmids or viral vectors, such as adeno-associated viruses (AAV), lentiviruses, adenoviruses, and other viral vectors, or combinations thereof. The proteins and one or more RNA guides can be packaged into one or more vectors, e.g., plasmids or viral vectors.

In some embodiments, the vectors, e.g., plasmids or viral vectors, are delivered to the tissue of interest by, e.g., intramuscular injection, intravenous administration, transdermal administration, intranasal administration, oral administration, or mucosal administration. Such delivery may be either via a single dose or multiple doses. One skilled in the art understands that the actual dosage to be delivered herein may vary greatly depending upon a variety of factors, such as the vector choices, the target cells, organisms, tissues, the general conditions of the subject to be treated, the degrees of transformation/modification sought, the administration routes, the administration modes, the types of transformation/modification sought, etc.

In certain embodiments, the delivery is via adenoviruses, which can be at a single dose containing at least $1 \times 10^5$ particles (also referred to as particle units, pu) of adenoviruses. In some embodiments, the dose preferably is at least about $1 \times 10^6$ particles, at least about $1 \times 10^7$ particles, at least about $1 \times 10^8$ particles, and at least about $1 \times 10^9$ particles of the adenoviruses. The delivery methods and the doses are described, e.g., in WO 2016205764 A1 and U.S. Pat. No. 8,454,972 B2, both of which are incorporated herein by reference in their entirety.

In some embodiments, the delivery is via a recombinant adeno-associated virus (rAAV) vector. For example, in some embodiments, a modified AAV vector may be used for delivery. Modified AAV vectors can be based on one or more of several capsid types, including AAV1, AV2, AAV5, AAV6, AAV8, AAV 8.2, AAV9, AAV rhlO, modified AAV vectors (e.g., modified AAV2, modified AAV3, modified AAV6) and pseudotyped AAV (e.g., AAV2/8, AAV2/5 and AAV2/6). Exemplary AAV vectors and techniques that may be used to produce rAAV particles are known in the art (see, e.g., Aponte-Ubillus et al. (2018) Appl. Microbiol. Biotechnol. 102(3): 1045-54; Zhong et al. (2012) J. Genet. Syndr. Gene Ther. Si: 008; West et al. (1987) Virology 160: 38-47 (1987); Tratschin et al. (1985) Mol. Cell. Biol. 5: 3251-60); U.S. Pat. Nos. 4,797,368 and 5,173,414; and International Publication Nos. WO 2015/054653 and WO 93/24641, each of which is incorporated herein by reference in its entirety).

In some embodiments, the delivery is via plasmids. The dosage can be a sufficient number of plasmids to elicit a response. In some cases, suitable quantities of plasmid DNA in plasmid compositions can be from about 0.1 to about 2 mg. Plasmids generally include (i) a promoter; (ii) a sequence encoding a nucleic acid-targeting CRISPR enzymes, operably linked to the promoter; (iii) a selectable marker; (iv) an origin of replication; and (v) a transcription terminator downstream of and operably linked to (ii). The plasmids can also encode the RNA components of a CRISPR complex, but one or more of these may instead be encoded on different vectors. The frequency of administration is within the ambit of the medical or veterinary practitioner (e.g., physician, veterinarian), or a person skilled in the art.

In another embodiment, the delivery is via liposomes or lipofectin formulations and the like, and can be prepared by methods known to those skilled in the art. Such methods are described, for example, in WO 2016205764 and U.S. Pat. Nos. 5,593,972; 5,589,466; and 5,580,859; each of which is incorporated herein by reference in its entirety.

In some embodiments, the delivery is via nanoparticles or exosomes. For example, exosomes have been shown to be particularly useful in delivery RNA.

Further means of introducing one or more components of the new CRISPR-Cas systems to the cell is by using cell penetrating peptides (CPP). In some embodiments, a cell penetrating peptide is linked to the CRISPR enzymes. In some embodiments, the CRISPR enzymes and/or RNA guides are coupled to one or more CPPs to transport them inside cells effectively (e.g., plant protoplasts). In some embodiments, the CRISPR enzymes and/or RNA guide(s) are encoded by one or more circular or non-circular DNA molecules that are coupled to one or more CPPs for cell delivery.

CPPs are short peptides of fewer than 35 amino acids derived either from proteins or from chimeric sequences capable of transporting biomolecules across cell membrane in a receptor independent manner. CPPs can be cationic peptides, peptides having hydrophobic sequences, amphipathic peptides, peptides having proline-rich and anti-microbial sequences, and chimeric or bipartite peptides. Examples of CPPs include, e.g., Tat (which is a nuclear transcriptional activator protein required for viral replication by HIV type 1), penetratin, Kaposi fibroblast growth factor (FGF) signal peptide sequence, integrin β3 signal peptide sequence, polyarginine peptide Args sequence, Guanine rich-molecular transporters, and sweet arrow peptide. CPPs and methods of using them are described, e.g., in Hillbrink et al., "Prediction of cell-penetrating peptides," *Methods Mol. Biol.*, 2015; 1324:39-58; Ramakrishna et al., "Gene disruption by cell-penetrating peptide-mediated delivery of Cas9 protein and guide RNA," *Genome Res.*, 2014 June; 24(6):1020-7; and WO 2016205764 A1; each of which is incorporated herein by reference in its entirety.

Various delivery methods for the CRISPR-Cas systems described herein are also described, e.g., in U.S. Pat. No. 8,795,965, EP 3009511, WO 2016205764, and WO 2017070605; each of which is incorporated herein by reference in its entirety.

EXAMPLES

The invention is further described in the following examples, which do not limit the scope of the invention described in the claims.

Example 1—Identification of Minimal Components for CLUST.018837 CRISPR-Cas System (FIGS. 1-5)

Genome and metagenome sequences were downloaded from NCBI (Benson et al., 2013; Pruitt et al., 2012), NCBI whole genome sequencing (WGS), and DOE JGI Integrated Microbial Genomes (Markowitz et al., 2012) and processed as described in the Detailed Description of this disclosure.

The identified CRISPR-Cas system described herein, designated CLUST.018837, contains a large single effector associated with CRISPR arrays found in *Acidithiobacillus, Clostridiales, Gordonia, Metallibacterium, Mycobacterium, Pelobacter, Rhodanobacter, Thioalkalivibrio,* and *Thiobacillus* bacteria, as well as uncultured metagenomic sequences collected from a range of environments, including termite gut, soil, ground water, waste water, marine, and hot springs environments (TABLE 1). CLUST.018837 effectors include the exemplary proteins detailed in TABLES 1 and 2. Exemplary direct repeat sequences for these systems are shown in TABLE 3.

Figure 1A:
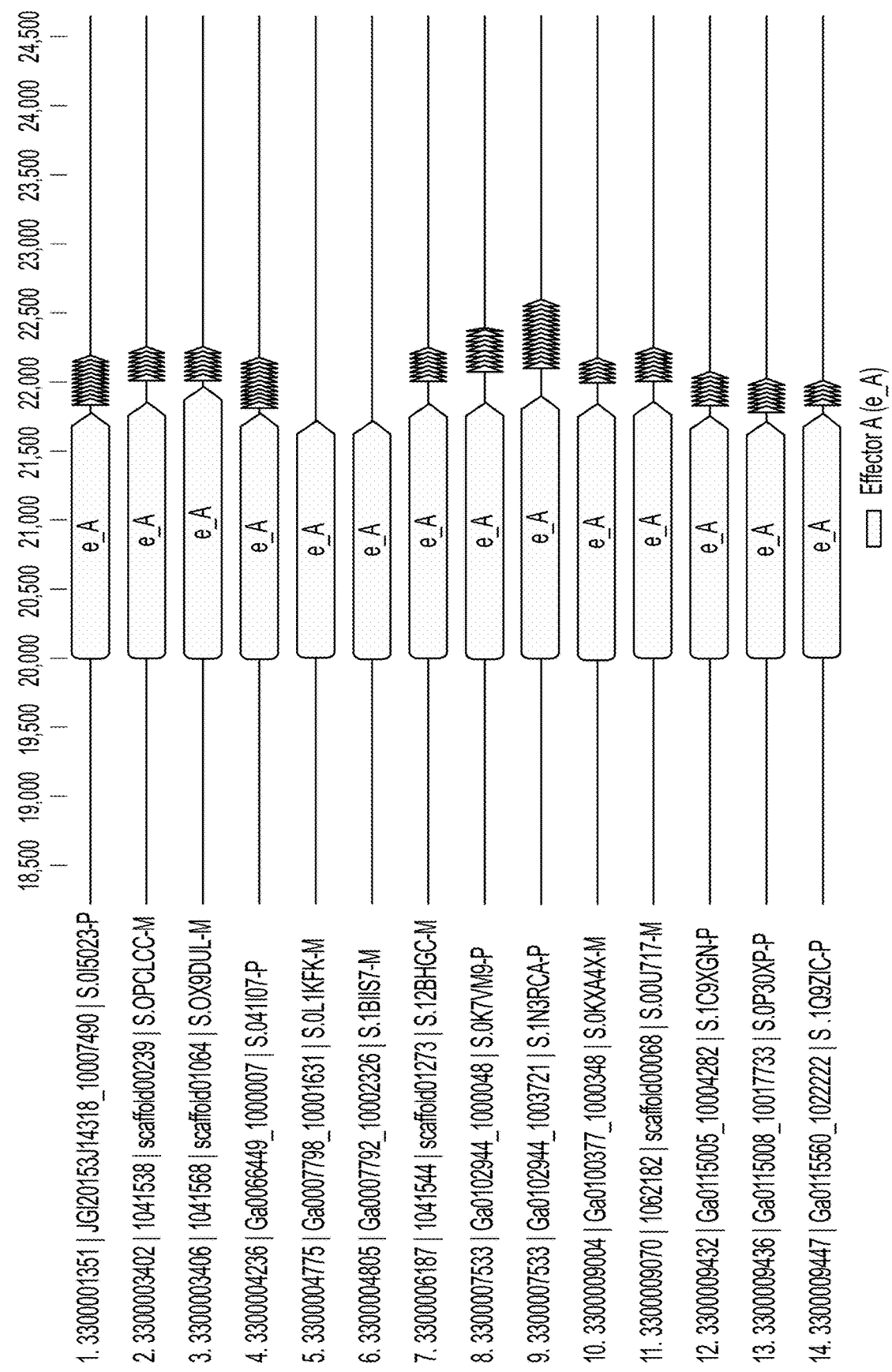
Figure 1B:
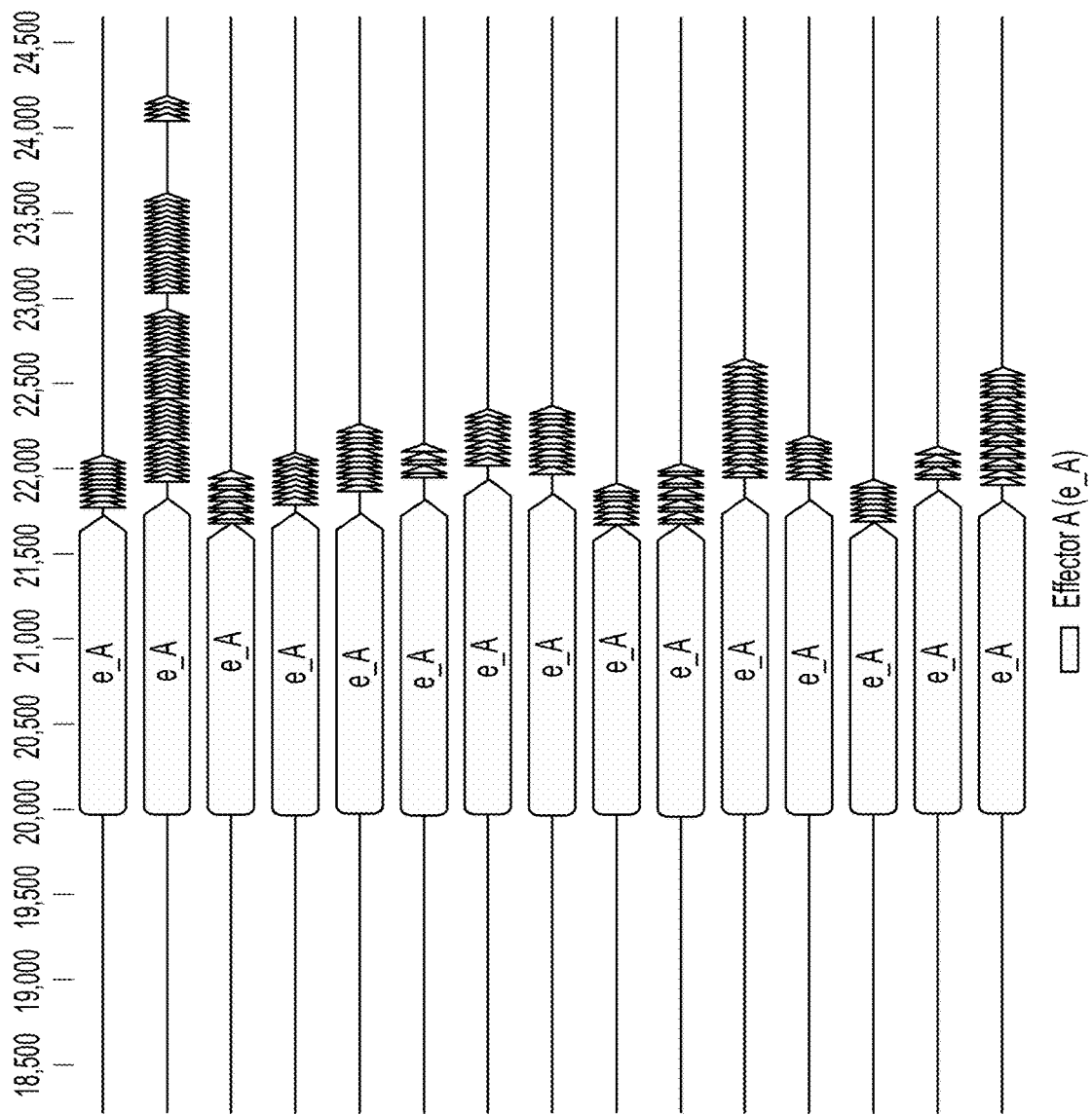

Examples of naturally occurring loci containing this effector complex are depicted in FIGS. 1A-B, indicating that for loci containing the CLUST.018837 CRISPR-Cas system, the effector protein co-occurs with a CRISPR array. No other families of large proteins were identified within a bi-directional 15 kb window that co-occur with the effector protein or CRISPR array.

Figure 2B:
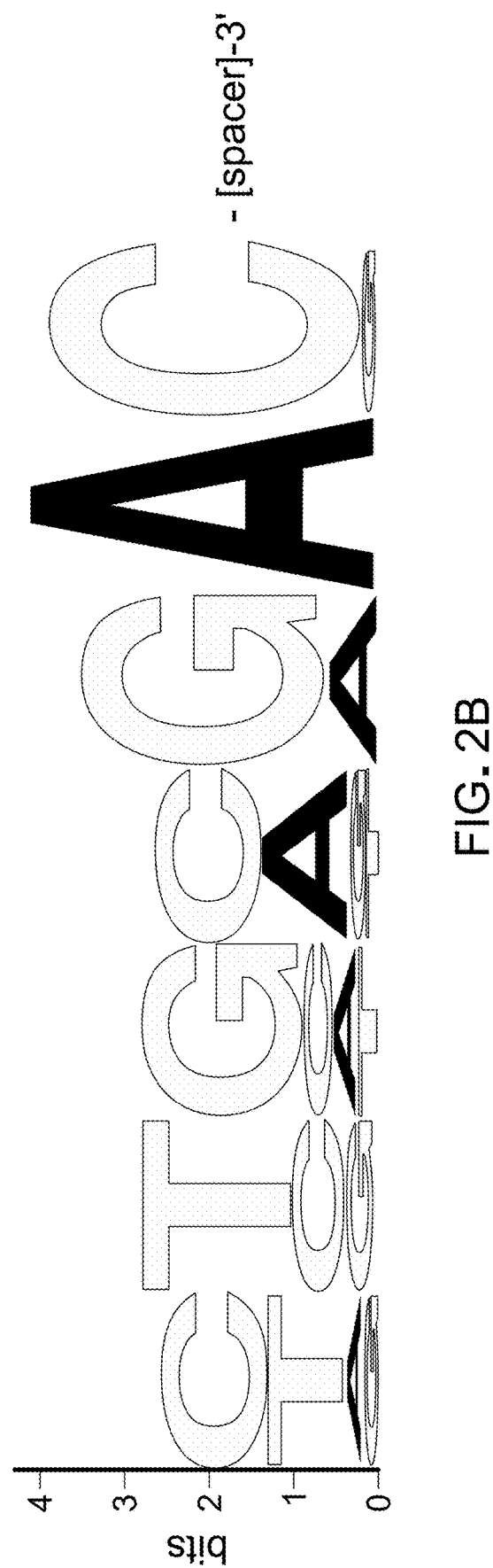
FIG. 2B is a weblogo that depicts the 3' end of a multiple sequence alignment of CLUST.018837 direct repeat sequences.

The direct repeat sequences for CLUST.018837 CRISPR-Cas systems show a consensus 5'-YBVMRAC-3' (wherein Y is C or T; B is T, C, or G; V is G, C, or A; M is A or C; and R is A or G) nucleotide sequence at the 3' terminal end (FIG. 2B).

Figure 3A:
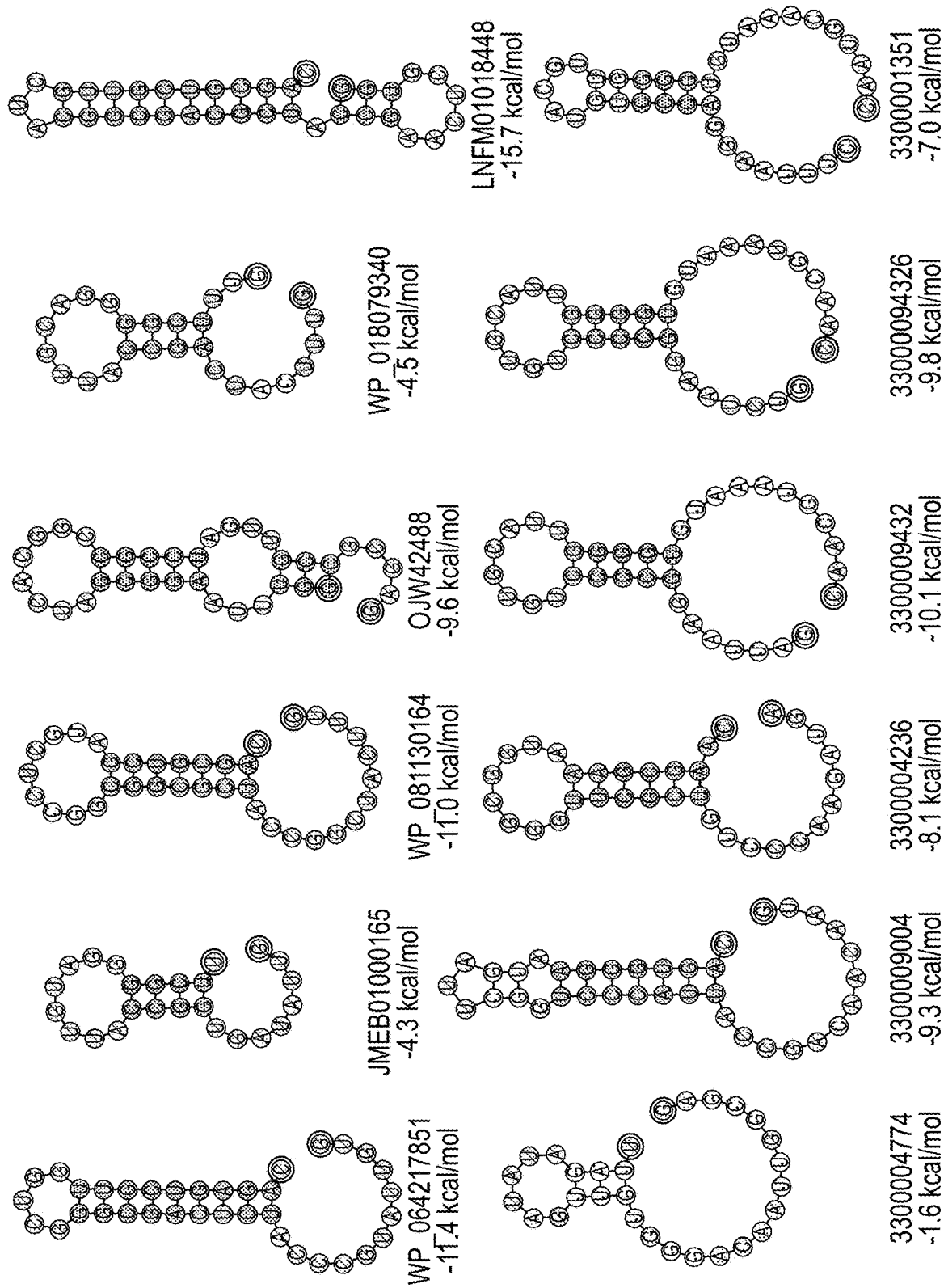
FIGS. 3A and 3B are a group of schematic diagrams that together show predicted secondary structure of the RNA transcript of examples of CLUST.018837 direct repeats.
Figure 3B:
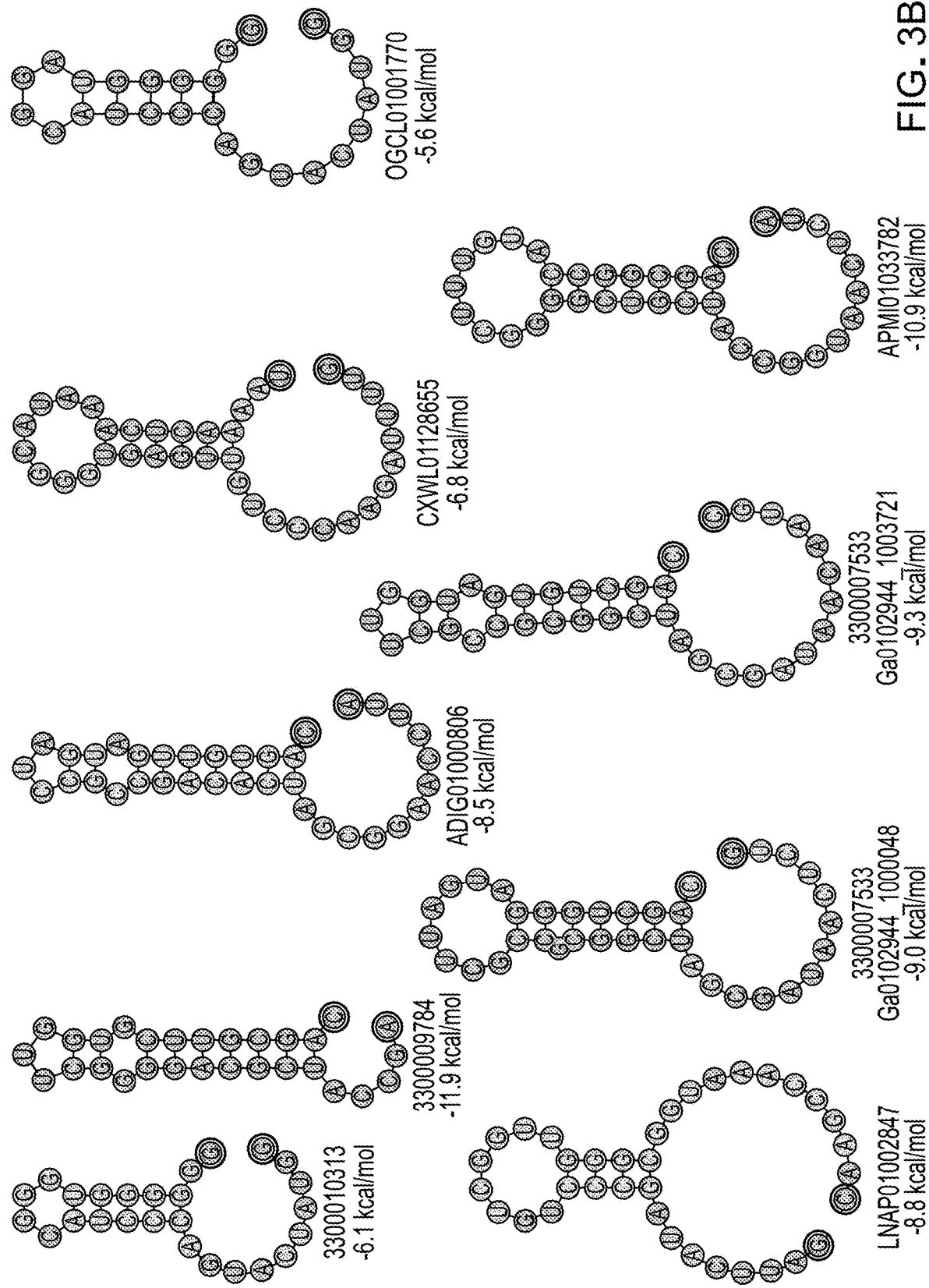
Figure 4A:
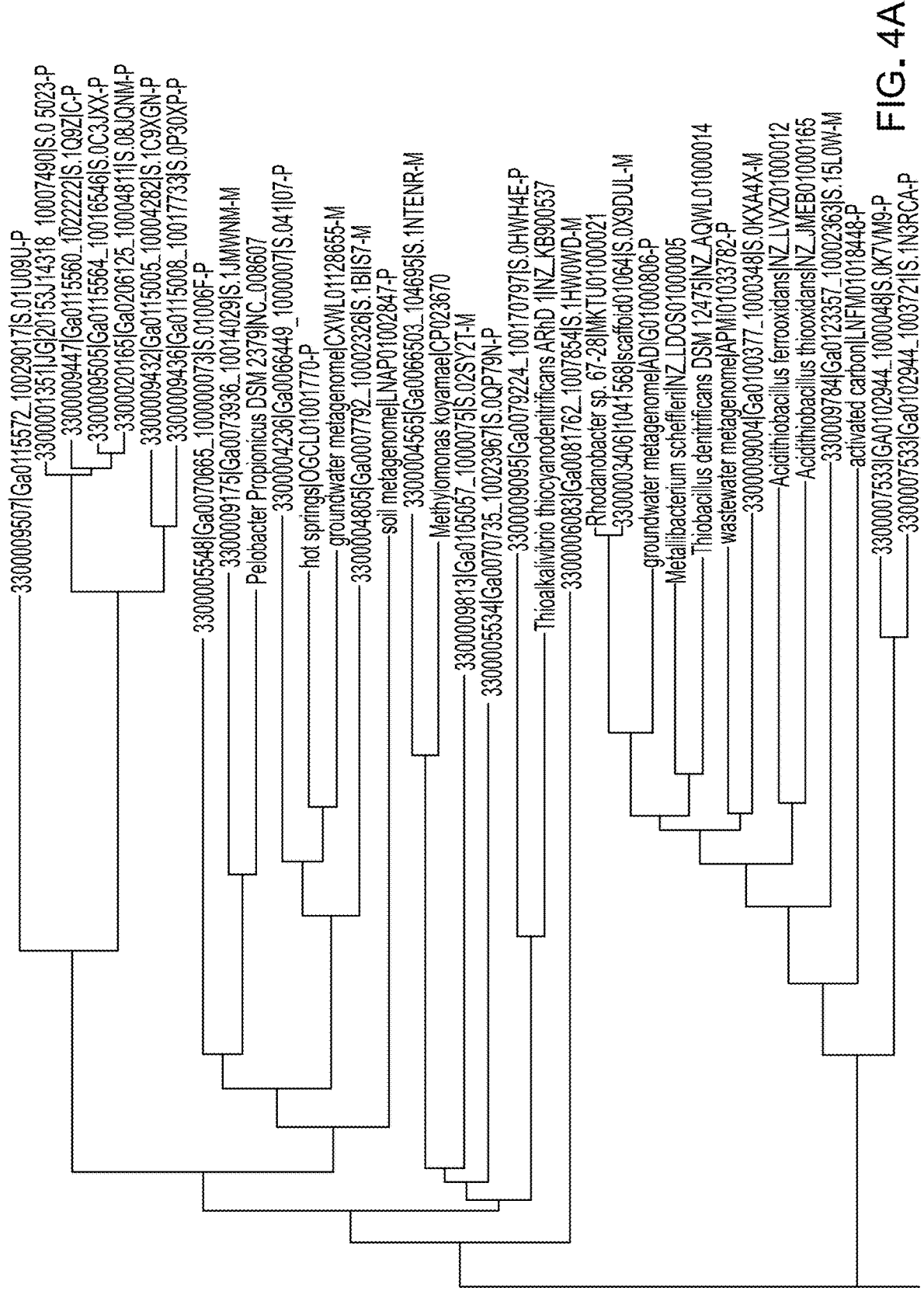
Figure 4B:
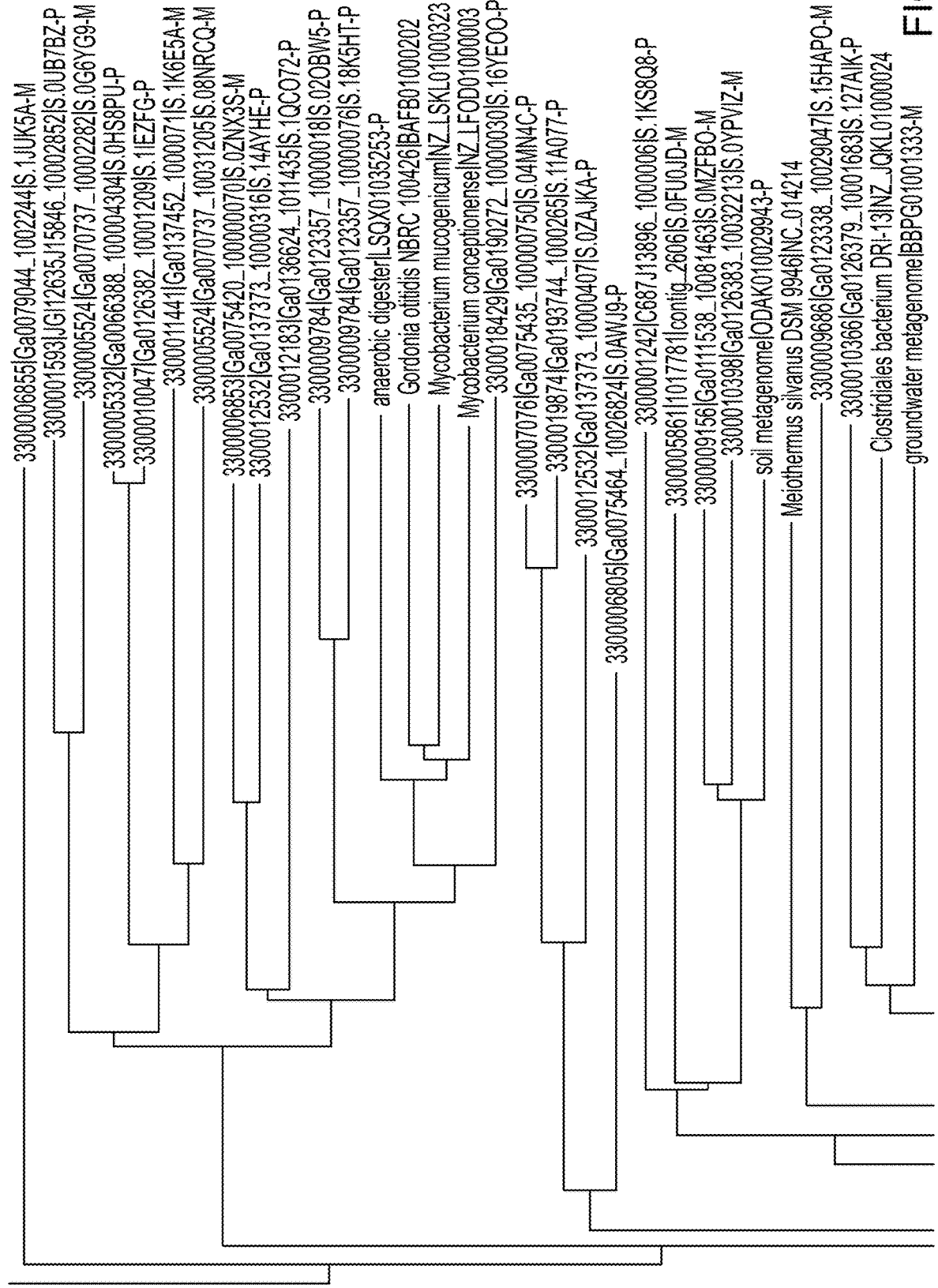
Figure 4C:
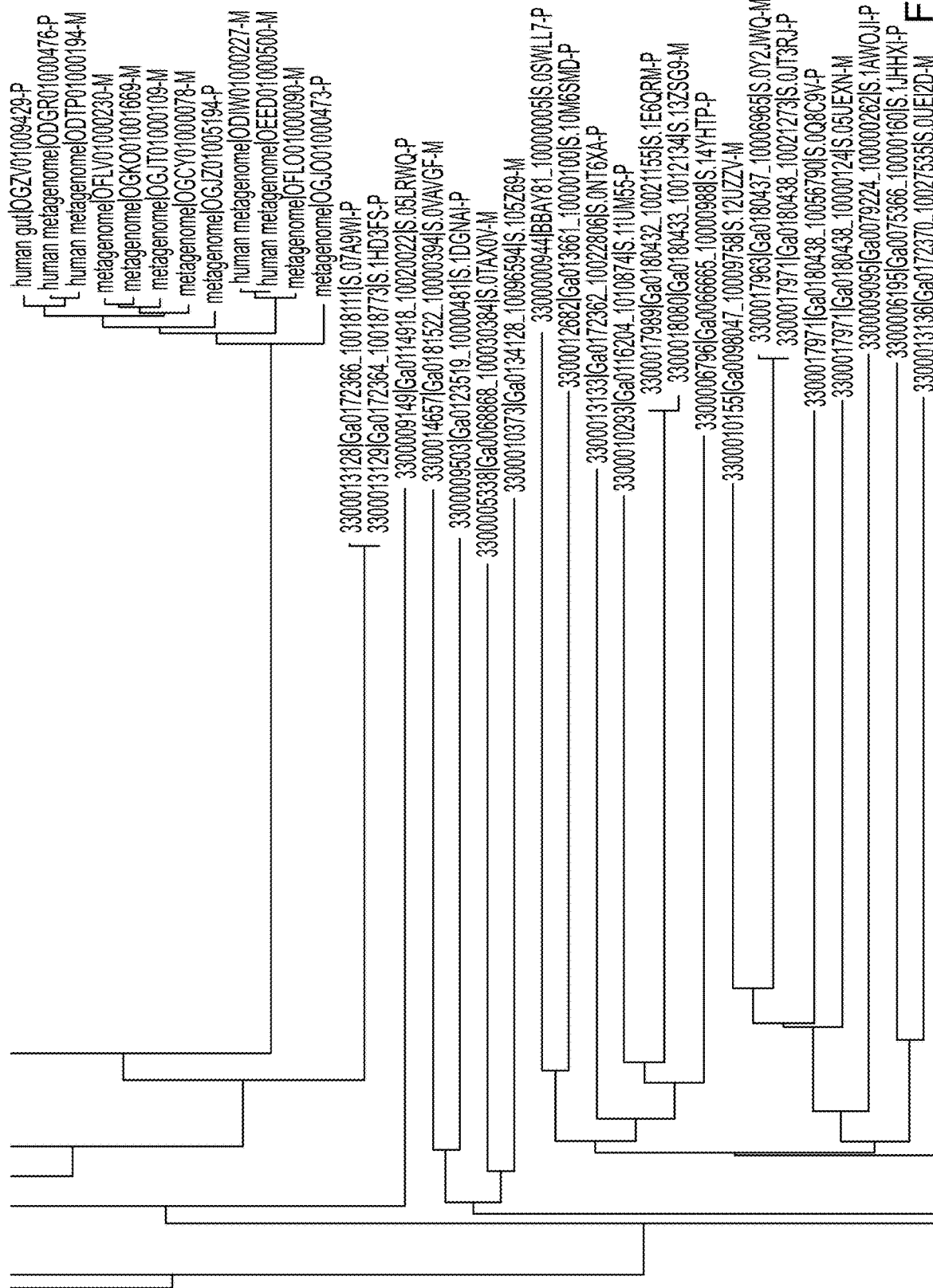
Figure 4D:
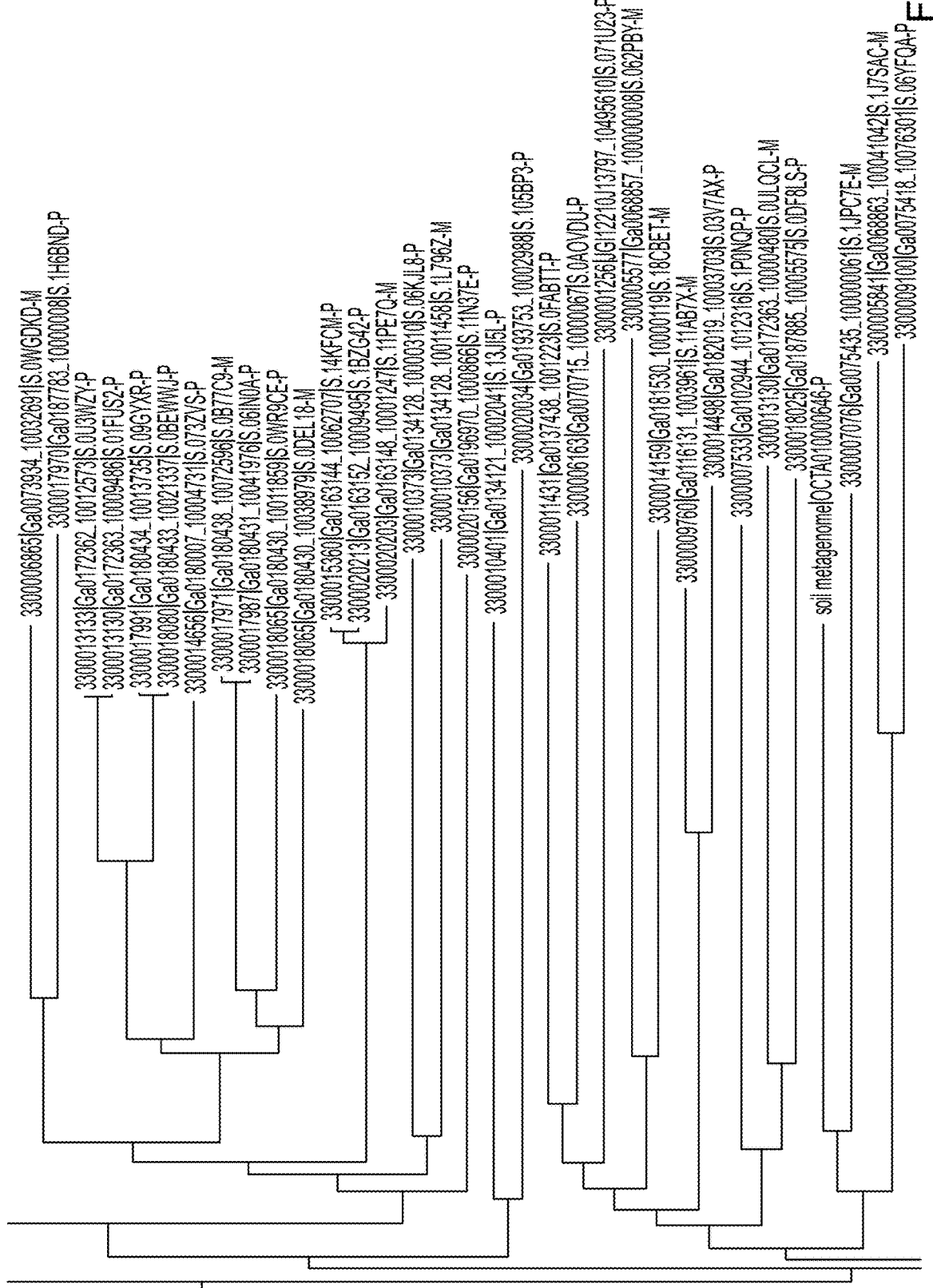
Figure 4E:
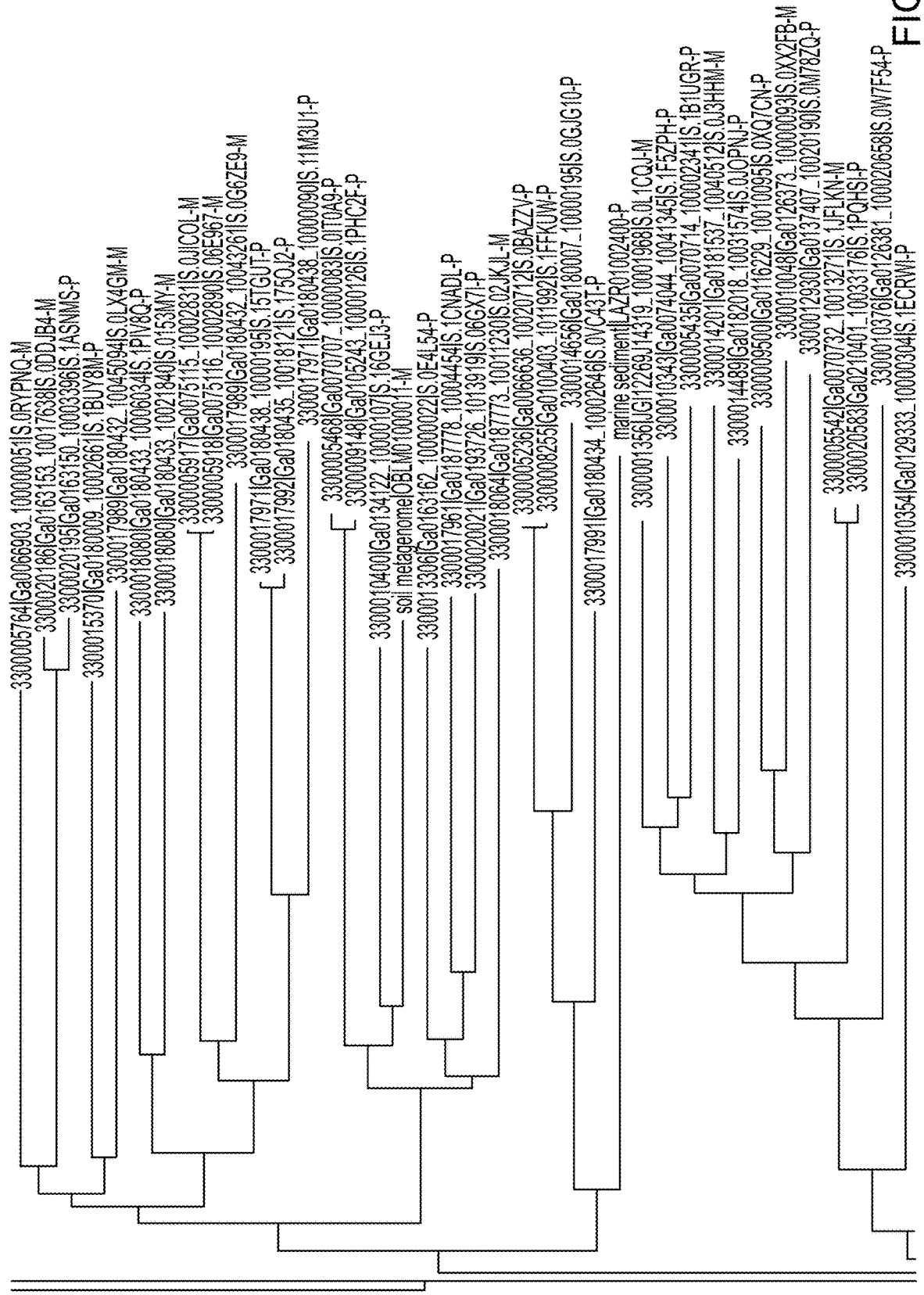
Figure 4F:
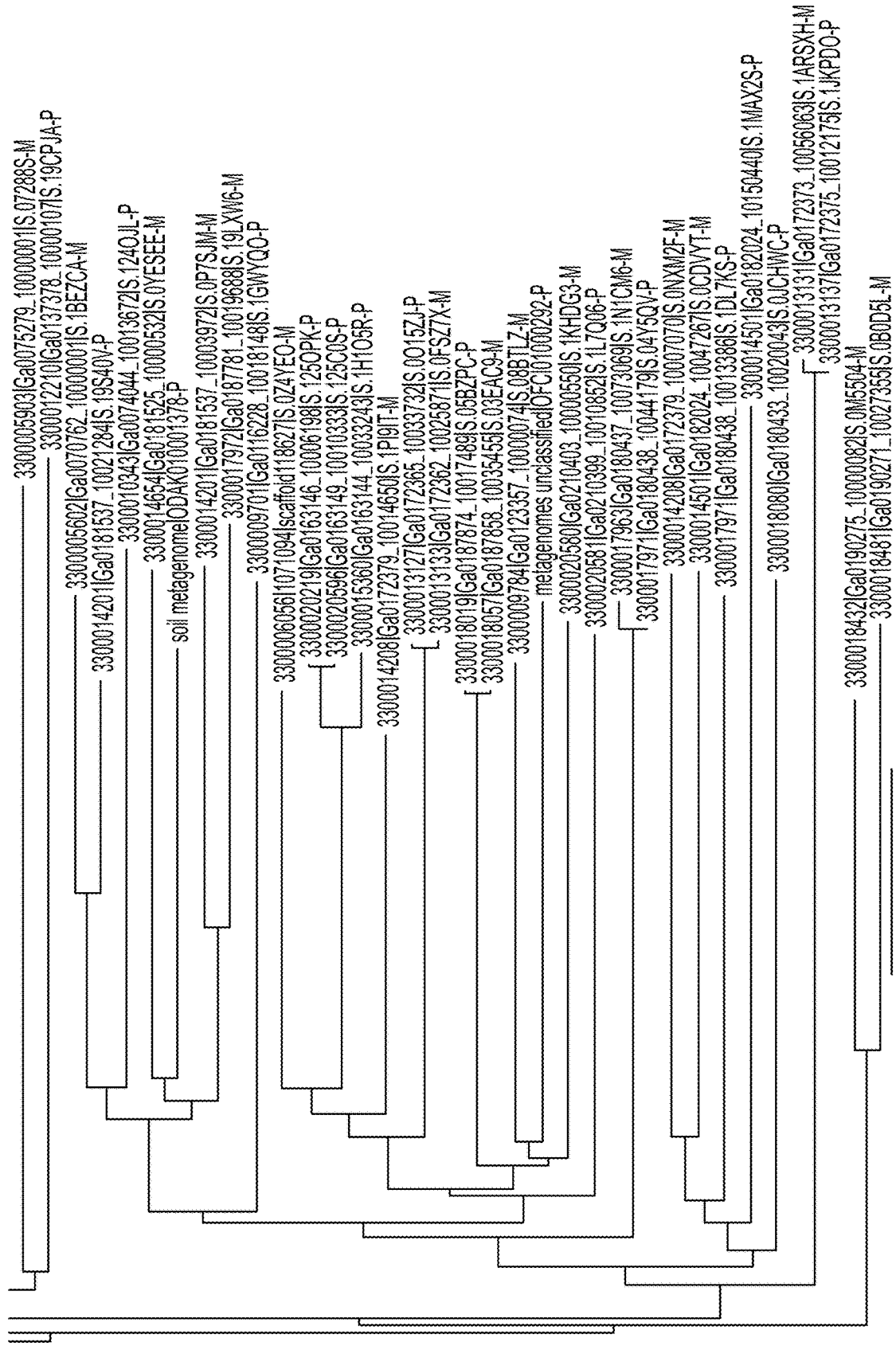

The predicted secondary structure of direct repeat sequences for example CLUST.018837 CRISPR-Cas systems is depicted in FIGS. 3A-B, indicating a high prevalence of predicted stem loop structures.

FIGS. 4A-F, combined, show a phylogenetic tree of CLUST.018837 effectors, showing that the family exhibits sequence diversity and at a top level comprises three sub-families.

An HMM profile search of the multiple sequence alignment of CLUST.018837 effectors against the PFAM database indicates the presence of the OrfB_Zn_ribbon domain (FIG. 5A). Manual inspection of the multiple sequence alignment reveals the locations of the conserved catalytic residues of the RuvC domain, indicated in FIG. 5B. Notably, the RuvC I domain does not contain any highly conserviced residues across this family.

TABLE 1

Representative CLUST.018837 Effector Proteins

| Species | effector accession | # spacers | cas1 | cas2 | effector size |
|---|---|---|---|---|---|
| *Metallibacterium scheffleri* (NZ_LDOS01000005) | WP_081130164.1 | 9 | N | N | 627 |
| *Thiobacillus denitrificans* DSM 12475 (NZ_AQWL01000014) | WP_018079340.1 | 2 | N | N | 633 |
| *Acidithiobacillus ferrooxidans* (NZ_LVXZ01000012) | WP_064217851.1 | 5 | N | N | 596 |
| *Acidithiobacillus thiooxidans* (JMEB01000165) | JMEB01000165_11 | 2 | N | N | 593 |
| *Acidithiobacillus thiooxidans* (JMEB01000165) | WP_051690567.1 | 2 | N | N | 615 |
| *Rhodanobacter* sp. 67-28 (MKTU01000021) | OJW42488.1 | 3 | N | N | 617 |
| activated carbon metagenome (LNFM01018448) | LNFM01018448_6 | 4 | N | N | 655 |
| aquatic-freshwater (3300004774\|Ga0007794_10001723) | 3300004774\|Ga0007794_10001723_8 | 2 | N | N | 573 |
| aquatic-freshwater (3300004776\|Ga0007800_10001775) | 3300004776\|Ga0007800_10001775_2 | 2 | N | N | 573 |
| aquatic-freshwater-aquifer (3300009004\|Ga0100377_1000348) | 3300009004\|Ga0100377_1000348_44 | 2 | N | N | 614 |
| aquatic-freshwater-freshwater sediment (3300004236\|Ga0066449_1000007) | 3300004236\|Ga0066449_1000007_83 | 5 | N | N | 582 |
| aquatic-marine (3300009432\|Ga0115005_10004282) | 3300009432\|Ga0115005_10004282_5 | 3 | N | N | 585 |
| aquatic-marine (3300009436\|Ga0115008_10017733) | 3300009436\|Ga0115008_10017733_3 | 3 | N | N | 587 |
| aquatic-marine (3300009436\|Ga0115008_10017733) | 3300009436\|Ga0115008_10017733_4 | 3 | N | N | 569 |
| aquatic-marine-pelagic marine (3300001351\|JGI20153J14318_10007490) | 3300001351\|JGI20153J14318_10007490_6 | 5 | N | N | 585 |
| aquatic-marine-pelagic marine (3300009447\|Ga0115560_1022222) | 3300009447\|Ga0115560_1022222_2 | 2 | N | N | 585 |
| aquatic-marine-pelagic marine (3300009505\|Ga0115564_10016546) | 3300009505\|Ga0115564_10016546_3 | 4 | N | N | 586 |
| aquatic-marine-seawater (3300020165\|Ga0206125_10004811) | 3300020165\|Ga0206125_10004811_3 | 4 | N | N | 592 |
| aquatic-thermal springs-hot spring (3300010313\|Ga0116211_1004493) | 3300010313\|Ga0116211_1004493_2 | 4 | N | N | 577 |
| arthropoda-digestive system-termite gut (3300009784\|Ga0123357_10002363) | 3300009784\|Ga0123357_10002363_9 | 24 | N | N | 614 |
| groundwater metagenome (ADIG01000806) | ADIG01000806_20 | 5 | N | N | 631 |
| groundwater metagenome (CXWL01128655) | CXWL01128655_18 | 3 | N | N | 575 |
| hot springs metagenome (OGCL01001770) | OGCL01001770_13 | 5 | N | N | 577 |
| soil metagenome (LNAP01002847) | LNAP01002847_16 | 3 | N | N | 579 |
| terrestrial-soil-pond soil (3300007533\|Ga0102944_1000048) | 3300007533\|Ga0102944_1000048_72 | 4 | N | N | 621 |
| terrestrial-soil-pond soil (3300007533\|Ga0102944_1003721) | 3300007533\|Ga0102944_1003721_10 | 6 | N | N | 632 |
| terrestrial-soil-pond soil (3300007533\|Ga0102944_1003721) | 3300007533\|Ga0102944_1003721_8 | 6 | N | N | 621 |
| wastewater metagenome (APMI01033782) | APMI01033782_24 | 9 | N | N | 612 |
| *Clostridiales bacterium* DRI-13 (NZ_JQKL01000024) | NZ_JQKL01000024_23 | 14 | N | N | 567 |
| *Clostridiales bacterium* DRI-13 (NZ_JQKL01000024) | WP_081908191.1 | 14 | N | N | 594 |

TABLE 1-continued

Representative CLUST.018837 Effector Proteins

| Species | effector accession | # spacers | cas1 | cas2 | effector size |
|---|---|---|---|---|---|
| *Gordonia otitidis* NBRC 100426 (BAFB01000202) | GAB36148.1 | 5 | N | N | 607 |
| *Gordonia otitidis* NBRC 100426 (BAFB01000202) | BAFB01000202_4 | 5 | N | N | 591 |
| *Gordonia otitidis* NBRC 100426 (NZ_BAFB01000202) | WP_039994403.1 | 5 | N | N | 597 |
| *Meiothermus silvanus* DSM 9946 (NC_014214) | WP_013159911.1 | 3 | N | N | 536 |
| *Methylomonas koyamae* (NZ_CP023670) | WP_096876841.1 | 4 | N | N | 589 |
| *Mycobacterium conceptionense* (NZ_LFOD01000003) | WP_048895525.1 | 9 | N | N | 603 |
| *Mycobacterium mucogenicum* (LSKL01000323) | WP_061006603.1 | 14 | N | N | 596 |
| *Pelobacter propionicus* DSM 2379 (CP000483) | WP_011733919.1 | 3 | N | N | 664 |
| *Thioalkalivibrio thiocyanodenitrificans* ARhD 1 (NZ_KB900537) | WP_018234394.1 | 3 | N | N | 599 |
| algae-green algae-macroalgal surface-ecklonia radiata 2 (3300000944\|BBAY81_10000005) | 3300000944\|BBAY81_10000005_89 | 6 | N | N | 636 |
| anaerobic digester metagenome (LSQX01035253) | LSQX01035253_23 | 5 | N | N | 592 |
| aquatic-freshwater (3300013131\|Ga0172373_10056063) | 3300013131\|Ga0172373_10056063_2 | 2 | N | N | 696 |
| aquatic-freshwater (3300013136\|Ga0172370_10027535) | 3300013136\|Ga0172370_10027535_4 | 5 | N | N | 670 |
| aquatic-freshwater (3300013137\|Ga0172375_10012175) | 3300013137\|Ga0172375_10012175_6 | 10 | N | N | 655 |
| aquatic-freshwater-anoxic lake water (3300010293\|Ga0116204_1010874) | 3300010293\|Ga0116204_1010874_1 | 3 | N | N | 601 |
| aquatic-freshwater-anoxic lake water (3300010293\|Ga0116204_1010874) | 3300010293\|Ga0116204_1010874_2 | 3 | N | N | 620 |
| aquatic-freshwater-aquifer (3300008255\|Ga0100403_1011992) | 3300008255\|Ga0100403_1011992_3 | 7 | N | N | 588 |
| aquatic-freshwater-bog (3300014155\|Ga0181524_10003409) | 3300014155\|Ga0181524_10003409_23 | 3 | N | N | 685 |
| aquatic-freshwater-bog (3300014156\|Ga0181518_10000096) | 3300014156\|Ga0181518_10000096_28 | 12 | N | N | 685 |
| aquatic-freshwater-bog (3300014158\|Ga0181521_10000063) | 3300014158\|Ga0181521_10000063_92 | 11 | N | N | 685 |
| aquatic-freshwater-bog (3300014159\|Ga0181530_10000119) | 3300014159\|Ga0181530_10000119_98 | 11 | N | N | 685 |
| aquatic-freshwater-bog (3300014201\|Ga0181537_10003972) | 3300014201\|Ga0181537_10003972_13 | 2 | N | N | 702 |
| aquatic-freshwater-bog (3300014201\|Ga0181537_10021284) | 3300014201\|Ga0181537_10021284_1 | 31 | N | N | 629 |
| aquatic-freshwater-bog (3300014201\|Ga0181537_10040512) | 3300014201\|Ga0181537_10040512_3 | 9 | N | N | 560 |
| aquatic-freshwater-bog (3300014654\|Ga0181525_10000532) | 3300014654\|Ga0181525_10000532_4 | 7 | N | N | 618 |
| aquatic-freshwater-bog (3300014657\|Ga0181522_10000394) | 3300014657\|Ga0181522_10000394_52 | 23 | N | N | 591 |
| aquatic-freshwater-bog (3300014657\|Ga0181522_10000394) | 3300014657\|Ga0181522_10000394_53 | 23 | N | N | 610 |
| aquatic-freshwater-freshwater lake hypolimnion (3300009175\|Ga0073936_10014029) | 3300009175\|Ga0073936_10014029_2 | 5 | N | N | 717 |
| aquatic-freshwater-freshwater microbial mat (3300015360\|Ga0163144_10020017) | 3300015360\|Ga0163144_10020017_5 | 5 | N | N | 611 |
| aquatic-freshwater-freshwater microbial mat (3300015360\|Ga0163144_10020017) | 3300015360\|Ga0163144_10020017_4 | 5 | N | N | 588 |
| aquatic-freshwater-freshwater microbial mat (3300015360\|Ga0163144_10033243) | 3300015360\|Ga0163144_10033243_8 | 2 | N | N | 603 |
| aquatic-freshwater-freshwater microbial mat (3300015360\|Ga0163144_10033243) | 3300015360\|Ga0163144_10033243_7 | 2 | N | N | 555 |
| aquatic-freshwater-freshwater microbial mat (3300015360\|Ga0163144_10062707) | 3300015360\|Ga0163144_10062707_6 | 24 | N | N | 571 |
| aquatic-freshwater-freshwater microbial mat (3300015360\|Ga0163144_10062707) | 3300015360\|Ga0163144_10062707_6 | 24 | N | N | 562 |

TABLE 1-continued

Representative CLUST.018837 Effector Proteins

| Species | effector accession | # spacers | cas1 | cas2 | effector size |
|---|---|---|---|---|---|
| aquatic-freshwater-freshwater microbial mat (3300020057\|Ga0163151_10006104) | 3300020057\|Ga0163151_10006104_16 | 5 | N | N | 611 |
| aquatic-freshwater-freshwater microbial mat (3300020186\|Ga0163153_10017638) | 3300020186\|Ga0163153_10017638_7 | 6 | N | N | 561 |
| aquatic-freshwater-freshwater microbial mat (3300020195\|Ga0163150_10003396) | 3300020195\|Ga0163150_10003396_14 | 19 | N | N | 570 |
| aquatic-freshwater-freshwater microbial mat (3300020203\|Ga0163148_10001247) | 3300020203\|Ga0163148_10001247_2 | 13 | N | N | 565 |
| aquatic-freshwater-freshwater microbial mat (3300020203\|Ga0163148_10001247) | 3300020203\|Ga0163148_10001247_2 | 13 | N | N | 574 |
| aquatic-freshwater-freshwater microbial mat (3300020213\|Ga0163152_10009495) | 3300020213\|Ga0163152_10009495_14 | 15 | N | N | 571 |
| aquatic-freshwater-freshwater microbial mat (3300020213\|Ga0163152_10009495) | 3300020213\|Ga0163152_10009495_14 | 15 | N | N | 562 |
| aquatic-freshwater-freshwater microbial mat (3300020219\|Ga0163146_10006198) | 3300020219\|Ga0163146_10006198_18 | 5 | N | N | 611 |
| aquatic-freshwater-freshwater microbial mat (3300020596\|Ga0163149_10010333) | 3300020596\|Ga0163149_10010333_13 | 8 | N | N | 611 |
| aquatic-freshwater-freshwater microbial mat (3300020596\|Ga0163149_10010333) | 3300020596\|Ga0163149_10010333_12 | 8 | N | N | 588 |
| aquatic-freshwater-freshwater sediment (3300004174\|Ga0066406_1000030) | 3300004174\|Ga0066406_1000030_21 | 6 | N | N | 593 |
| aquatic-freshwater-freshwater sediment (3300004200\|Ga0066422_1000628) | 3300004200\|Ga0066422_1000628_7 | 6 | N | N | 593 |
| aquatic-freshwater-freshwater sediment (3300004205\|Ga0066415_1000057) | 3300004205\|Ga0066415_1000057_23 | 6 | N | N | 593 |
| aquatic-freshwater-freshwater sediment (3300004565\|Ga0066503_104695) | 3300004565\|Ga0066503_104695_4 | 6 | N | N | 593 |
| aquatic-freshwater-glacier valley (3300009686\|Ga0123338_10029047) | 3300009686\|Ga0123338_10029047_2 | 4 | N | N | 535 |
| aquatic-freshwater-groundwater (3300001242\|C687J13896_1000006) | 3300001242\|C687J13896_1000006_134 | 24 | N | N | 599 |
| aquatic-freshwater-groundwater (3300005236\|Ga0066636_10020712) | 3300005236\|Ga0066636_10020712_3 | 8 | N | N | 588 |
| aquatic-freshwater-groundwater (3300014208\|Ga0172379_10007070) | 3300014208\|Ga0172379_10007070_15 | 3 | N | N | 623 |
| aquatic-freshwater-groundwater (3300014208\|Ga0172379_10014650) | 3300014208\|Ga0172379_10014650_2 | 5 | N | N | 612 |
| aquatic-freshwater-groundwater (3300014613\|Ga0180008_1000021) | 3300014613\|Ga0180008_1000021_8 | 6 | N | N | 627 |
| aquatic-freshwater-groundwater (3300014613\|Ga0180008_1000021) | 3300014613\|Ga0180008_1000021_9 | 6 | N | N | 658 |
| aquatic-freshwater-groundwater (3300014656\|Ga0180007_10000195) | 3300014656\|Ga0180007_10000195_44 | 3 | N | N | 627 |
| aquatic-freshwater-groundwater (3300014656\|Ga0180007_10000195) | 3300014656\|Ga0180007_10000195_48 | 3 | N | N | 658 |
| aquatic-freshwater-groundwater (3300014656\|Ga0180007_10004731) | 3300014656\|Ga0180007_10004731_7 | 3 | N | N | 560 |
| aquatic-freshwater-groundwater (3300014656\|Ga0180007_10004731) | 3300014656\|Ga0180007_10004731_5 | 3 | N | N | 561 |
| aquatic-freshwater-groundwater (3300015370\|Ga0180009_10002661) | 3300015370\|Ga0180009_10002661_7 | 8 | N | N | 589 |
| aquatic-freshwater-peatland (3300009760\|Ga0116131_1003961) | 3300009760\|Ga0116131_1003961_2 | 5 | N | N | 606 |
| aquatic-freshwater-peatland (3300018019\|Ga0187874_10017489) | 3300018019\|Ga0187874_10017489_1 | 4 | N | N | 623 |
| aquatic-freshwater-peatland (3300018025\|Ga0187885_10005575) | 3300018025\|Ga0187885_10005575_2 | 6 | N | N | 619 |
| aquatic-freshwater-peatland (3300018025\|Ga0187885_10005575) | 3300018025\|Ga0187885_10005575_1 | 6 | N | N | 642 |
| aquatic-freshwater-peatland (3300018057\|Ga0187858_10035455) | 3300018057\|Ga0187858_10035455_2 | 2 | N | N | 623 |
| aquatic-freshwater-polar desert sand (3300012183\|Ga0136624_1011435) | 3300012183\|Ga0136624_1011435_1 | 3 | N | N | 556 |

TABLE 1-continued

Representative CLUST.018837 Effector Proteins

| Species | effector accession | # spacers | cas1 | cas2 | effector size |
|---|---|---|---|---|---|
| aquatic-freshwater-polar desert sand (3300012682\|Ga0136611_10000100) | 3300012682\|Ga0136611_10000100_4 | 12 | N | N | 582 |
| aquatic-freshwater-sediment (3300013127\|Ga0172365_10004082) | 3300013127\|Ga0172365_10004082_5 | 2 | N | N | 547 |
| aquatic-freshwater-sediment (3300013127\|Ga0172365_10004082) | 3300013127\|Ga0172365_10004082_3 | 2 | N | N | 538 |
| aquatic-freshwater-sediment (3300013127\|Ga0172365_10033732) | 3300013127\|Ga0172365_10033732_1 | 2 | N | N | 610 |
| aquatic-freshwater-sediment (3300013128\|Ga0172366_10016188) | 3300013128\|Ga0172366_10016188_4 | 2 | N | N | 547 |
| aquatic-freshwater-sediment (3300013128\|Ga0172366_10018111) | 3300013128\|Ga0172366_10018111_5 | 6 | N | N | 543 |
| aquatic-freshwater-sediment (3300013129\|Ga0172364_10001281) | 3300013129\|Ga0172364_10001281_26 | 16 | N | N | 593 |
| aquatic-freshwater-sediment (3300013129\|Ga0172364_10017363) | 3300013129\|Ga0172364_10017363_4 | 2 | N | N | 547 |
| aquatic-freshwater-sediment (3300013129\|Ga0172364_10018773) | 3300013129\|Ga0172364_10018773_2 | 7 | N | N | 543 |
| aquatic-freshwater-sediment (3300013129\|Ga0172364_10045136) | 3300013129\|Ga0172364_10045136_2 | 2 | N | N | 610 |
| aquatic-freshwater-sediment (3300013130\|Ga0172363_10000480) | 3300013130\|Ga0172363_10000480_22 | 4 | N | N | 593 |
| aquatic-freshwater-sediment (3300013130\|Ga0172363_10009486) | 3300013130\|Ga0172363_10009486_8 | 2 | N | N | 547 |
| aquatic-freshwater-sediment (3300013130\|Ga0172363_10014785) | 3300013130\|Ga0172363_10014785_2 | 2 | N | N | 566 |
| aquatic-freshwater-sediment (3300013133\|Ga0172362_10012573) | 3300013133\|Ga0172362_10012573_3 | 2 | N | N | 547 |
| aquatic-freshwater-sediment (3300013133\|Ga0172362_10022806) | 3300013133\|Ga0172362_10022806_8 | 2 | N | N | 566 |
| aquatic-freshwater-sediment (3300013133\|Ga0172362_10025871) | 3300013133\|Ga0172362_10025871_2 | 2 | N | N | 610 |
| aquatic-marine (3300010155\|Ga0098047_10009758) | 3300010155\|Ga0098047_10009758_2 | 2 | N | N | 620 |
| aquatic-marine-aqueous (3300006805\|Ga0075464_10026824) | 3300006805\|Ga0075464_10026824_2 | 10 | N | N | 479 |
| aquatic-marine-aqueous (3300006805\|Ga0075464_10026824) | 3300006805\|Ga0075464_10026824_2 | 10 | N | N | 481 |
| aquatic-marine-deep subsurface (3300009149\|Ga0114918_10020022) | 3300009149\|Ga0114918_10020022_2 | 5 | N | N | 664 |
| aquatic-marine-diffuse hydrothermal flow volcanic vent (3300006083\|Ga0081762_1007854) | 3300006083\|Ga0081762_1007854_6 | 8 | N | N | 572 |
| aquatic-marine-freshwater to marine saline gradient (3300010354\|Ga0129333_10000304) | 3300010354\|Ga0129333_10000304_8 | 6 | N | N | 551 |
| aquatic-marine-freshwater to marine saline gradient (3300010354\|Ga0129333_10000304) | 3300010354\|Ga0129333_10000304_10 | 6 | N | N | 574 |
| aquatic-marine-pelagic marine (3300009507\|Ga0115572_10029017) | 3300009507\|Ga0115572_10029017_2 | 4 | N | N | 600 |
| aquatic-non marine saline and alkaline-hypersaline lake sediment (3300017963\|Ga0180437_10000100) | 3300017963\|Ga0180437_10000100_151 | 17 | N | N | 642 |
| aquatic-non marine saline and alkaline-hypersaline lake sediment (3300017963\|Ga0180437_10000153) | 3300017963\|Ga0180437_10000153_25 | 10 | N | N | 732 |
| aquatic-non marine saline and alkaline-hypersaline lake sediment (3300017963\|Ga0180437_10000488) | 3300017963\|Ga0180437_10000488_78 | 6 | N | N | 584 |
| aquatic-non marine saline and alkaline-hypersaline lake sediment (3300017963\|Ga0180437_10000692) | 3300017963\|Ga0180437_10000692_13 | 5 | N | N | 654 |
| aquatic-non marine saline and alkaline-hypersaline lake sediment (3300017963\|Ga0180437_10006965) | 3300017963\|Ga0180437_10006965_20 | 6 | N | N | 670 |
| aquatic-non marine saline and alkaline-hypersaline lake sediment (3300017963\|Ga0180437_10006965) | 3300017963\|Ga0180437_10006965_20 | 6 | N | N | 645 |
| aquatic-non marine saline and alkaline-hypersaline lake sediment (3300017963\|Ga0180437_10073069) | 3300017963\|Ga0180437_10073069_2 | 7 | N | N | 625 |
| aquatic-non marine saline and alkaline-hypersaline lake sediment (3300017971\|Ga0180438_10000090) | 3300017971\|Ga0180438_10000090_91 | 10 | N | N | 732 |

TABLE 1-continued

Representative CLUST.018837 Effector Proteins

| Species | effector accession | # spacers | cas1 | cas2 | effector size |
|---|---|---|---|---|---|
| aquatic-non marine saline and alkaline-hypersaline lake sediment (3300017971\|Ga0180438_10000124) | 3300017971\|Ga0180438_10000124_114 | 5 | N | N | 654 |
| aquatic-non marine saline and alkaline-hypersaline lake sediment (3300017971\|Ga0180438_10000195) | 3300017971\|Ga0180438_10000195_144 | 17 | N | N | 642 |
| aquatic-non marine saline and alkaline-hypersaline lake sediment (3300017971\|Ga0180438_10013386) | 3300017971\|Ga0180438_10013386_7 | 8 | N | N | 584 |
| aquatic-non marine saline and alkaline-hypersaline lake sediment (3300017971\|Ga0180438_10021273) | 3300017971\|Ga0180438_10021273_1 | 6 | N | N | 645 |
| aquatic-non marine saline and alkaline-hypersaline lake sediment (3300017971\|Ga0180438_10044179) | 3300017971\|Ga0180438_10044179_5 | 3 | N | N | 674 |
| aquatic-non marine saline and alkaline-hypersaline lake sediment (3300017971\|Ga0180438_10056790) | 3300017971\|Ga0180438_10056790_2 | 6 | N | N | 645 |
| aquatic-non marine saline and alkaline-hypersaline lake sediment (3300017971\|Ga0180438_10072596) | 3300017971\|Ga0180438_10072596_2 | 3 | N | N | 556 |
| aquatic-non marine saline and alkaline-hypersaline lake sediment (3300017987\|Ga0180431_10022214) | 3300017987\|Ga0180431_10022214_3 | 6 | N | N | 572 |
| aquatic-non marine saline and alkaline-hypersaline lake sediment (3300017987\|Ga0180431_10041976) | 3300017987\|Ga0180431_10041976_5 | 11 | N | N | 556 |
| aquatic-non marine saline and alkaline-hypersaline lake sediment (3300017989\|Ga0180432_10002388) | 3300017989\|Ga0180432_10002388_5 | 6 | N | N | 572 |
| aquatic-non marine saline and alkaline-hypersaline lake sediment (3300017989\|Ga0180432_10021155) | 3300017989\|Ga0180432_10021155_3 | 20 | N | N | 630 |
| aquatic-non marine saline and alkaline-hypersaline lake sediment (3300017989\|Ga0180432_10021155) | 3300017989\|Ga0180432_10021155_5 | 20 | N | N | 643 |
| aquatic-non marine saline and alkaline-hypersaline lake sediment (3300017989\|Ga0180432_10043261) | 3300017989\|Ga0180432_10043261_1 | 2 | N | N | 651 |
| aquatic-non marine saline and alkaline-hypersaline lake sediment (3300017989\|Ga0180432_10045094) | 3300017989\|Ga0180432_10045094_6 | 4 | N | N | 633 |
| aquatic-non marine saline and alkaline-hypersaline lake sediment (3300017991\|Ga0180434_10002646) | 3300017991\|Ga0180434_10002646_1 | 6 | N | N | 572 |
| aquatic-non marine saline and alkaline-hypersaline lake sediment (3300017991\|Ga0180434_10013735) | 3300017991\|Ga0180434_10013735_9 | 9 | N | N | 549 |
| aquatic-non marine saline and alkaline-hypersaline lake sediment (3300017992\|Ga0180435_10018121) | 3300017992\|Ga0180435_10018121_11 | 6 | N | N | 642 |
| aquatic-non marine saline and alkaline-hypersaline lake sediment (3300018065\|Ga0180430_10011859) | 3300018065\|Ga0180430_10011859_2 | 11 | N | N | 560 |
| aquatic-non marine saline and alkaline-hypersaline lake sediment (3300018065\|Ga0180430_10038979) | 3300018065\|Ga0180430_10038979_3 | 7 | N | N | 567 |
| aquatic-non marine saline and alkaline-hypersaline lake sediment (3300018080\|Ga0180433_10006034) | 3300018080\|Ga0180433_10006034_17 | 13 | N | N | 575 |
| aquatic-non marine saline and alkaline-hypersaline lake sediment (3300018080\|Ga0180433_10006034) | 3300018080\|Ga0180433_10006034_18 | 13 | N | N | 598 |
| aquatic-non marine saline and alkaline-hypersaline lake sediment (3300018080\|Ga0180433_10012134) | 3300018080\|Ga0180433_10012134_6 | 13 | N | N | 610 |
| aquatic-non marine saline and alkaline-hypersaline lake sediment (3300018080\|Ga0180433_10012134) | 3300018080\|Ga0180433_10012134_6 | 13 | N | N | 642 |
| aquatic-non marine saline and alkaline-hypersaline lake sediment (3300018080\|Ga0180433_10020043) | 3300018080\|Ga0180433_10020043_6 | 12 | N | N | 640 |
| aquatic-non marine saline and alkaline-hypersaline lake sediment (3300018080\|Ga0180433_10021337) | 3300018080\|Ga0180433_10021337_5 | 10 | N | N | 549 |

TABLE 1-continued

Representative CLUST.018837 Effector Proteins

| Species | effector accession | # spacers | cas1 | cas2 | effector size |
|---|---|---|---|---|---|
| aquatic-non marine saline and alkaline-hypersaline lake sediment (3300018080\|Ga0180433_10021840) | 3300018080\|Ga0180433_10021840_7 | 5 | N | N | 584 |
| aquatic-non marine saline and alkaline-hypersaline lake sediment (3300018080\|Ga0180433_10021840) | 3300018080\|Ga0180433_10021840_7 | 5 | N | N | 601 |
| aquatic-non marine saline and alkaline-hypersaline mat (3300001256\|JGI12210J13797_10495608) | 3300001256\|JGI12210J13797_10495608_9 | 5 | N | N | 580 |
| aquatic-non marine saline and alkaline-hypersaline mat (3300001256\|JGI12210J13797_10495610) | 3300001256\|JGI12210J13797_10495610_14 | 7 | N | N | 580 |
| aquatic-non marine saline and alkaline-saline lake (3300005917\|Ga0075115_10002831) | 3300005917\|Ga0075115_10002831_4 | 14 | N | N | 635 |
| aquatic-non marine saline and alkaline-saline lake (3300005918\|Ga0075116_10002890) | 3300005918\|Ga0075116_10002890_7 | 3 | N | N | 635 |
| aquatic-sediment-groundwater sediment (3300011414\|Ga0137442_1000121) | 3300011414\|Ga0137442_1000121_10 | 17 | N | N | 631 |
| aquatic-sediment-groundwater sediment (3300011431\|Ga0137438_1001223) | 3300011431\|Ga0137438_1001223_2 | 8 | N | N | 631 |
| aquatic-sediment-groundwater sediment (3300011441\|Ga0137452_1000071) | 3300011441\|Ga0137452_1000071_9 | 7 | N | N | 553 |
| aquatic-thermal springs-hot spring (3300006855\|Ga0079044_1002244) | 3300006855\|Ga0079044_1002244_2 | 3 | N | N | 625 |
| aquatic-thermal springs-hot spring (3300006855\|Ga0079044_1002244) | 3300006855\|Ga0079044_1002244_2 | 3 | N | N | 649 |
| aquatic-thermal springs-hot spring (3300009503\|Ga0123519_10000481) | 3300009503\|Ga0123519_10000481_19 | 8 | N | N | 598 |
| aquatic-thermal springs-hot spring (3300009503\|Ga0123519_10000481) | 3300009503\|Ga0123519_10000481_22 | 8 | N | N | 618 |
| aquatic-thermal springs-hot spring sediment (3300006865\|Ga0073934_10032691) | 3300006865\|Ga0073934_10032691_1 | 2 | N | N | 572 |
| aquatic-thermal springs-hypersaline mat (3300001340\|JGI20133J14441_1002607) | 3300001340\|JGI20133J14441_1002607_2 | 11 | N | N | 580 |
| arthropoda-digestive system-termite gut (3300009784\|Ga0123357_10000018) | 3300009784\|Ga0123357_10000018_105 | 2 | N | N | 619 |
| arthropoda-digestive system-termite gut (3300009784\|Ga0123357_10000074) | 3300009784\|Ga0123357_10000074_42 | 2 | N | N | 667 |
| arthropoda-digestive system-termite gut (3300009784\|Ga0123357_10000076) | 3300009784\|Ga0123357_10000076_32 | 2 | N | N | 618 |
| groundwater metagenome (BBPF01004549) | BBPF01004549_6 | 9 | N | N | 584 |
| groundwater metagenome (BBPG01001333) | BBPG01001333_4 | 8 | N | N | 584 |
| human gut metagenome (OGZV01009429) | OGZV01009429_1 | 3 | N | N | 567 |
| human gut metagenome (OKWZ01000119) | OKWZ01000119_10 | 4 | N | N | 563 |
| human metagenome (ODGR01000476) | ODGR01000476_16 | 2 | N | N | 567 |
| human metagenome (ODIG01000268) | ODIG01000268_14 | 4 | N | N | 563 |
| human metagenome (ODIP01002140) | ODIP01002140_2 | 4 | N | N | 567 |
| human metagenome (ODIW01000227) | ODIW01000227_18 | 4 | N | N | 567 |
| human metagenome (ODJA01000260) | ODJA01000260_38 | 4 | N | N | 563 |
| human metagenome (ODJP01000229) | ODJP01000229_55 | 4 | N | N | 563 |
| human metagenome (ODKZ01007116) | ODKZ01007116_1 | 3 | N | N | 567 |
| human metagenome (ODMO01000523) | ODMO01000523_12 | 4 | N | N | 563 |
| human metagenome (ODTN01000195) | ODTN01000195_35 | 4 | N | N | 563 |
| human metagenome (ODTP01000194) | ODTP01000194_18 | 4 | N | N | 567 |
| human metagenome (ODWI01002981) | ODWI01002981_3 | 2 | N | N | 563 |
| human metagenome (ODZZ01005262) | ODZZ01005262_2 | 4 | N | N | 563 |
| human metagenome (OEED01000500) | OEED01000500_25 | 4 | N | N | 567 |
| human metagenome (OEFT01000529) | OEFT01000529_3 | 4 | N | N | 563 |
| marine sediment metagenome (LAZR01002400) | LAZR01002400_15 | 20 | N | N | 492 |
| marine sediment metagenome (LAZR01002400) | LAZR01002400_19 | 20 | N | N | 511 |
| metagenome (FLSK01003024) | FLSK01003024_2 | 4 | N | N | 563 |
| metagenome (OFLM01000072) | OFLM01000072_9 | 4 | N | N | 567 |
| metagenome (OFLO01000090) | OFLO01000090_50 | 4 | N | N | 567 |

TABLE 1-continued

Representative CLUST.018837 Effector Proteins

| Species | effector accession | # spacers | cas1 | cas2 | effector size |
|---|---|---|---|---|---|
| metagenome (OFLU01000140) | OFLU01000140_22 | 3 | N | N | 567 |
| metagenome (OFLV01000230) | OFLV01000230_3 | 3 | N | N | 567 |
| metagenome (OGCY01000078) | OGCY01000078_30 | 3 | N | N | 567 |
| metagenome (OGJO01000473) | OGJO01000473_2 | 4 | N | N | 563 |
| metagenome (OGJT01000109) | OGJT01000109_37 | 3 | N | N | 567 |
| metagenome (OGJZ01005194) | OGJZ01005194_5 | 2 | N | N | 567 |
| metagenome (OGKO01001669) | OGKO01001669_8 | 4 | N | N | 567 |
| metagenomes unclassified sequences. (OFCI01000292) | OFCI01000292_37 | 5 | N | N | 582 |
| plants-endosphere-populus endosphere (3300006048|Ga0075363_100000001) | 3300006048|Ga0075363_100000001_25 | 4 | N | N | 634 |
| plants-endosphere-populus endosphere (3300006048|Ga0075363_100000001) | 3300006048|Ga0075363_100000001_20 | 4 | N | N | 648 |
| plants-endosphere-populus endosphere (3300006048|Ga0075363_100000020) | 3300006048|Ga0075363_100000020_49 | 18 | N | N | 488 |
| plants-endosphere-populus endosphere (3300006178|Ga0075367_10000108) | 3300006178|Ga0075367_10000108_6 | 4 | N | N | 634 |
| plants-endosphere-populus endosphere (3300006178|Ga0075367_10000108) | 3300006178|Ga0075367_10000108_6 | 4 | N | N | 648 |
| plants-endosphere-populus endosphere (3300006195|Ga0075366_10000160) | 3300006195|Ga0075366_10000160_13 | 4 | N | N | 634 |
| plants-peat moss-host associated (3300009500|Ga0116229_10010095) | 3300009500|Ga0116229_10010095_9 | 21 | N | N | 604 |
| plants-peat moss-host associated (3300009701|Ga0116228_10018148) | 3300009701|Ga0116228_10018148_5 | 4 | N | N | 683 |
| plants-rhizoplane-corn rhizosphere (3300005577|Ga0068857_100000008) | 3300005577|Ga0068857_100000008_197 | 15 | N | N | 698 |
| plants-rhizoplane-miscanthus rhizosphere (3300005338|Ga0068868_100030384) | 3300005338|Ga0068868_100030384_5 | 5 | N | N | 637 |
| plants-rhizoplane-switchgrass rhizosphere (3300005841|Ga0068863_100041042) | 3300005841|Ga0068863_100041042_2 | 13 | N | N | 693 |
| plants-rhizoplane-switchgrass rhizosphere (3300013306|Ga0163162_10000022) | 3300013306|Ga0163162_10000022_153 | 20 | N | N | 586 |
| plants-rhizosphere-miscanthus rhizosphere (3300009148|G a0105243_10000126) | 3300009148|Ga0105243_10000126_60 | 10 | N | N | 626 |
| plants-rhizosphere-populus rhizosphere (3300006846|Ga0075430_100000057) | 3300006846|Ga0075430_100000057_67 | 3 | N | N | 617 |
| plants-rhizosphere-populus rhizosphere (3300006853|Ga0075420_100000070) | 3300006853|Ga0075420_100000070_3 | 3 | N | N | 617 |
| plants-rhizosphere-populus rhizosphere (3300006854|Ga0075425_100000037) | 3300006854|Ga0075425_100000037_57 | 22 | N | N | 488 |
| plants-rhizosphere-populus rhizosphere (3300006903|Ga0075426_10000611) | 3300006903|Ga0075426_10000611_28 | 2 | N | N | 646 |
| plants-rhizosphere-populus rhizosphere (3300006914|Ga0075436_100000782) | 3300006914|Ga0075436_100000782_9 | 2 | N | N | 646 |
| plants-rhizosphere-populus rhizosphere (3300007076|Ga0075435_100000061) | 3300007076|Ga0075435_100000061_47 | 2 | N | N | 646 |
| plants-rhizosphere-populus rhizosphere (3300007076|Ga0075435_100000750) | 3300007076|Ga0075435_100000750_29 | 22 | N | N | 488 |
| plants-rhizosphere-populus rhizosphere (3300009100|Ga0075418_10076301) | 3300009100|Ga0075418_10076301_2 | 6 | N | N | 710 |
| plants-rhizosphere-populus rhizosphere (3300009100|Ga0075418_10076301) | 3300009100|Ga0075418_10076301_2 | 6 | N | N | 713 |
| plants-rhizosphere-populus rhizosphere (3300009156|Ga0111538_10081463) | 3300009156|Ga0111538_10081463_8 | 3 | N | N | 558 |
| plants-rhizosphere-switchgrass rhizosphere (3300005548|Ga0070665_100000073) | 3300005548|Ga0070665_100000073_173 | 7 | N | N | 597 |
| soil metagenome (OBLM01000011) | OBLM01000011_1 | 2 | N | N | 635 |
| soil metagenome (OCTA010000646) | OCTA010000646_37 | 6 | N | N | 628 |
| soil metagenome (ODAK010001378) | ODAK010001378_33 | 5 | N | N | 617 |
| soil metagenome (ODAK010029943) | ODAK010029943_5 | 11 | N | N | 595 |
| soil metagenome (ODAK010029943) | ODAK010029943_6 | 11 | N | N | 638 |
| terrestrial-soil (3300005602|Ga0070762_10000001) | 3300005602|Ga0070762_10000001_34 | 50 | N | N | 628 |
| terrestrial-soil (3300005602|Ga0070762_10000001) | 3300005602|Ga0070762_10000001_32 | 50 | N | N | 660 |
| terrestrial-soil (3300006796|Ga0066665_10000988) | 3300006796|Ga0066665_10000988_15 | 2 | N | N | 628 |
| terrestrial-soil (3300018429|Ga0190272_10000030) | 3300018429|Ga0190272_10000030_113 | 4 | N | N | 622 |

TABLE 1-continued

Representative CLUST.018837 Effector Proteins

| Species | effector accession | # spacers | cas1 | cas2 | effector size |
|---|---|---|---|---|---|
| terrestrial-soil (3300018432\|Ga0190275_10000082) | 3300018432\|Ga0190275_10000082_154 | 10 | N | N | 605 |
| terrestrial-soil (3300018481\|Ga0190271_10027355) | 3300018481\|Ga0190271_10027355_3 | 7 | N | N | 596 |
| terrestrial-soil (3300019874\|Ga0193744_1000265) | 3300019874\|Ga0193744_1000265_21 | 4 | N | N | 488 |
| terrestrial-soil (3300020021\|Ga0193726_1013919) | 3300020021\|Ga0193726_1013919_1 | 3 | N | N | 711 |
| terrestrial-soil (3300020021\|Ga0193726_1013919) | 3300020021\|Ga0193726_1013919_1 | 3 | N | N | 745 |
| terrestrial-soil (3300020034\|Ga0193753_10002988) | 3300020034\|Ga0193753_10002988_10 | 2 | N | N | 630 |
| terrestrial-soil (3300020034\|Ga0193753_10002988) | 3300020034\|Ga0193753_10002988_9 | 2 | N | N | 669 |
| terrestrial-soil (3300020156\|Ga0196970_1000866) | 3300020156\|Ga0196970_1000866_40 | 6 | N | N | 559 |
| terrestrial-soil (3300020579\|Ga0210407_10000200) | 3300020579\|Ga0210407_10000200_14 | 8 | N | N | 621 |
| terrestrial-soil (3300020580\|Ga0210403_10000550) | 3300020580\|Ga0210403_10000550_35 | 8 | N | N | 621 |
| terrestrial-soil (3300020580\|Ga0210403_10001296) | 3300020580\|Ga0210403_10001296_17 | 5 | N | N | 518 |
| terrestrial-soil (3300020581\|Ga0210399_10010852) | 3300020581\|Ga0210399_10010852_9 | 9 | N | N | 596 |
| terrestrial-soil (3300020583\|Ga0210401_10033176) | 3300020583\|Ga0210401_10033176_5 | 3 | N | N | 518 |
| terrestrial-soil-agricultural soil (3300005435\|Ga0070714_100002341) | 3300005435\|Ga0070714_100002341_12 | 11 | N | N | 521 |
| terrestrial-soil-agricultural soil (3300009095\|Ga0079224_100000262) | 3300009095\|Ga0079224_100000262_28 | 6 | N | N | 573 |
| terrestrial-soil-agricultural soil (3300009095\|Ga0079224_100170797) | 3300009095\|Ga0079224_100170797_3 | 3 | N | N | 618 |
| terrestrial-soil-bog forest soil (3300010343\|Ga0074044_10013672) | 3300010343\|Ga0074044_10013672_1 | 9 | N | N | 672 |
| terrestrial-soil-bog forest soil (3300010343\|Ga0074044_10041345) | 3300010343\|Ga0074044_10041345_4 | 3 | N | N | 561 |
| terrestrial-soil-corn, switchgrass and miscanthus rhizosphere (3300005468\|Ga0070707_100000083) | 3300005468\|Ga0070707_100000083_12 | 3 | N | N | 628 |
| terrestrial-soil-corn, switchgrass and miscanthus rhizosphere (3300006163\|Ga0070715_10000067) | 3300006163\|Ga0070715_10000067_44 | 42 | N | N | 690 |
| terrestrial-soil-fen (3300014498\|Ga0182019_10003703) | 3300014498\|Ga0182019_10003703_1 | 4 | N | N | 630 |
| terrestrial-soil-forest soil (3300001131\|JGI12631J13338_1000296) | 3300001131\|JGI12631J13338_1000296_13 | 22 | N | N | 674 |
| terrestrial-soil-forest soil (3300001593\|JGI12635J15846_10002852) | 3300001593\|JGI12635J15846_10002852_1 | 22 | N | N | 674 |
| terrestrial-soil-groundwater sand (3300009813\|Ga0105057_1000075) | 3300009813\|Ga0105057_1000075_5 | 8 | N | N | 600 |
| terrestrial-soil-groundwater sand (3300009813\|Ga0105057_1000075) | 3300009813\|Ga0105057_1000075_5 | 8 | N | N | 604 |
| terrestrial-soil-palsa (3300014489\|Ga0182018_10031574) | 3300014489\|Ga0182018_10031574_1 | 4 | N | N | 525 |
| terrestrial-soil-palsa (3300014501\|Ga0182024_10047267) | 3300014501\|Ga0182024_10047267_8 | 13 | N | N | 643 |
| terrestrial-soil-palsa (3300014501\|Ga0182024_10150440) | 3300014501\|Ga0182024_10150440_2 | 3 | N | N | 640 |
| terrestrial-soil-peatlands soil (3300001356\|JGI12269J14319_10001968) | 3300001356\|JGI12269J14319_10001968_12 | 5 | N | N | 552 |
| terrestrial-soil-pond soil (3300007533\|Ga0102944_1012316) | 3300007533\|Ga0102944_1012316_2 | 13 | N | N | 622 |
| terrestrial-soil-rice paddy soil (3300005903\|Ga0075279_10000001) | 3300005903\|Ga0075279_10000001_30 | 5 | N | N | 701 |
| terrestrial-soil-surface soil (3300005524\|Ga0070737_10002282) | 3300005524\|Ga0070737_10002282_10 | 8 | N | N | 739 |
| terrestrial-soil-surface soil (3300005524\|Ga0070737_10031205) | 3300005524\|Ga0070737_10031205_1 | 5 | N | N | 615 |
| terrestrial-soil-surface soil (3300005524\|Ga0070737_10031205) | 3300005524\|Ga0070737_10031205_1 | 5 | N | N | 628 |
| terrestrial-soil-surface soil (3300005534\|Ga0070735_10023967) | 3300005534\|Ga0070735_10023967_5 | 2 | N | N | 607 |
| terrestrial-soil-surface soil (3300005542\|Ga0070732_10013271) | 3300005542\|Ga0070732_10013271_3 | 2 | N | N | 520 |

TABLE 1-continued

Representative CLUST.018837 Effector Proteins

| Species | effector accession | # spacers | cas1 | cas2 | effector size |
|---|---|---|---|---|---|
| terrestrial-soil-terrestrial soil (3300010373\|Ga0134128_10000310) | 3300010373\|Ga0134128_10000310_109 | 4 | N | N | 670 |
| terrestrial-soil-terrestrial soil (3300010373\|Ga0134128_10011458) | 3300010373\|Ga0134128_10011458_1 | 4 | N | N | 675 |
| terrestrial-soil-terrestrial soil (3300010373\|Ga0134128_10096594) | 3300010373\|Ga0134128_10096594_3 | 4 | N | N | 674 |
| terrestrial-soil-terrestrial soil (3300010400\|Ga0134122_10000107) | 3300010400\|Ga0134122_10000107_57 | 2 | N | N | 631 |
| terrestrial-soil-terrestrial soil (3300010401\|Ga0134121_10002041) | 3300010401\|Ga0134121_10002041_17 | 2 | N | N | 564 |
| terrestrial-soil-tropical forest soil (3300004633\|Ga0066395_10000027) | 3300004633\|Ga0066395_10000027_32 | 9 | N | N | 586 |
| terrestrial-soil-tropical forest soil (3300005332\|Ga0066388_100004304) | 3300005332\|Ga0066388_100004304_4 | 7 | N | N | 644 |
| terrestrial-soil-tropical forest soil (3300005332\|Ga0066388_100004304) | 3300005332\|Ga0066388_100004304_2 | 7 | N | N | 619 |
| terrestrial-soil-tropical forest soil (3300005764\|Ga0066903_100000051) | 3300005764\|Ga0066903_100000051_27 | 9 | N | N | 586 |
| terrestrial-soil-tropical forest soil (3300010047\|Ga0126382_10001209) | 3300010047\|Ga0126382_10001209_14 | 5 | N | N | 651 |
| terrestrial-soil-tropical forest soil (3300010047\|Ga0126382_10001209) | 3300010047\|Ga0126382_10001209_12 | 5 | N | N | 619 |
| terrestrial-soil-tropical forest soil (3300010048\|Ga0126373_10000093) | 3300010048\|Ga0126373_10000093_102 | 4 | N | N | 598 |
| terrestrial-soil-tropical forest soil (3300010366\|Ga0126379_10001683) | 3300010366\|Ga0126379_10001683_10 | 6 | N | N | 619 |
| terrestrial-soil-tropical forest soil (3300010376\|Ga0126381_100020658) | 3300010376\|Ga0126381_100020658_4 | 3 | N | N | 592 |
| terrestrial-soil-tropical forest soil (3300010398\|Ga0126383_10032213) | 3300010398\|Ga0126383_10032213_5 | 2 | N | N | 570 |
| terrestrial-soil-tropical peatland (3300017961\|Ga0187778_10004454) | 3300017961\|Ga0187778_10004454_1 | 4 | N | N | 612 |
| terrestrial-soil-tropical peatland (3300017970\|Ga0187783_10000008) | 3300017970\|Ga0187783_10000008_23 | 16 | N | N | 565 |
| terrestrial-soil-tropical peatland (3300017972\|Ga0187781_10019688) | 3300017972\|Ga0187781_10019688_5 | 13 | N | N | 705 |
| terrestrial-soil-tropical peatland (3300018064\|Ga0187773_10011230) | 3300018064\|Ga0187773_10011230_2 | 2 | N | N | 640 |
| terrestrial-soil-vadose zone soil (3300012204\|Ga0137374_10001132) | 3300012204\|Ga0137374_10001132_4 | 22 | N | N | 666 |
| terrestrial-soil-vadose zone soil (3300012210\|Ga0137378_10000107) | 3300012210\|Ga0137378_10000107_47 | 3 | N | N | 670 |
| terrestrial-soil-vadose zone soil (3300012532\|Ga0137373_10000316) | 3300012532\|Ga0137373_10000316_4 | 22 | N | N | 666 |
| terrestrial-soil-vadose zone soil (3300012532\|Ga0137373_10000407) | 3300012532\|Ga0137373_10000407_43 | 26 | N | N | 479 |
| terrestrial-soil-vadose zone soil (3300012930\|Ga0137407_10020190) | 3300012930\|Ga0137407_10020190_4 | 5 | N | N | 545 |
| wastewater-nutrient removal-wastewater effluent (3300005987\|1071089\|scaffold14955) | 3300005987\|1071089\|scaffold14955_2 | 13 | N | N | 632 |
| wastewater-nutrient removal-wastewater effluent (3300005988\|1071091\|scaffold06014) | 3300005988\|1071091\|scaffold06014_8 | 13 | N | N | 632 |
| wastewater-nutrient removal-wastewater effluent (3300006056\|1071094\|scaffold118627) | 3300006056\|1071094\|scaffold118627_2 | 5 | N | N | 632 |

TABLE 2

Amino Acid Sequences of Representative CLUST.018837 Effector Proteins*

```
>WP_081130164.1
[Metallibacterium scheffleri]
MKLSPALPPTGDVLIYEYGARVDGDCLPAVGDQIAKARRLYNDLVAVIRGIVDEMRGFVLKHAGSEALALQARIDG
LSEAFDAARAANDEDRMKQIAGERRALWAELGEQVKAVRKAHRAEIQELFLSRIGKKSTCDTYQMRCKAVGDGLGW
ATANQVLDAALQAFKTSFQRGQAPRFARGEEKIQDTLTLQFTAAGGVPVAALLSGDHSELSMVSSCGRRKYGSFSF
RLGSASADTYANGTWQYHRPLPDGATVGLARLVRRSVGKDFKWALQLMVKRPATEPAMMEGRKPLVAVHFGWAGDA
SGRRVAGITDGADPGVARVLQLPVEVEDGIRRAAEFQSARDEARDVIMTTIKNIAWGDAVACLGESSQFMHGSEPW
LRARLSEELSTIRRLPAQHVAPRRLHRLCGLLRATNQMHDELEAWRKQDRLAWQASAHMARRARNLRKDFYRRVAI
DLARRYSAIVLEPLDLAAAALKVNEITGEKTEFAKKARSGRVVAAIYELESSIRWAAAKSGTALLDLSGAETAARC
```

TABLE 2-continued

Amino Acid Sequences of Representative CLUST.018837 Effector Proteins*

GICGGASQSDESNSQVLHCVECGAELDRKKNGAAIAWQFAHENLDEAVTDFWAAVIAQRCEHAEKTREKKAKMAEG
RRLARTLSAGVSAVGSRNV (SEQ ID NO: 1)

>WP_018079340.1
[*Thiobacillus denitrificans* DSM 12475]
MSEIKPSLLPQGNVLIYEYGARLDKDCIQAVGDQIIKSRRLYNDLVATIRGIVTEMKAFVLEKSGPDAQRCQEEID
ALNAAFDAARAENNEDAMKCIAESRREKWRELAVEVKEARKNHRSDIQSMYLSRIGKNSACETYRIRSKAVADGLG
WATANQVLDAALTAFKKSFARGNAPRFAVGEDKDQDTLTLQFTAAGGVPVDTILAGKHGEVALSPTNGCGPRKYGE
LRFRLGAAKAATNATGTWQYHRPLPDGATAGLCRLIRRRVGKDYKWAIQMQVKRPPIEQEALAGRKPLVAVHFGWA
ANDEGRCVAGITDGADPGQAYVLKLPAEVEQSLVRSSAIQSERDSARDAIVPRLKEIEVPDMDIESVESLPPDSPE
VRLARAADELKAIHRLPANHVAIRRLHRLCGMLRDVDFLPEWLEDWRKEDRLQWQSAAHIARRARNTRKGFYRQTA
IDLARQYSSIVLEPLDLAKAAVKIDEITGERTEFAKKARAGRVVAALYELESAIRWAAAKAGSAMFELTGETASRC
SICGGDVLPDETNGQLLHCTECGADLDRKQNGAAMAWQLANDDLESLVEAFWTETFAARRSAENEQAEKKQKMAEG
RRKARTPIGGENTEVSRDSGNGANA (SEQ ID NO: 2)

>WP_064217851.1
[*Acidithiobacillus ferrooxidans*]
MSTITYEYGVRLEPDCIQHVDHQIILARGTYNEMIAAMRSVHDAAQSFQMEKAGPEGRAIAARIEALNTAFKEARA
QQQEESLLQATAVERRQCWRDLGVILKGVRQEHKKTLQEVEYNRIGINKGTDTYAIRCKAVADGLGWATAQDVLNR
AIIAWKMSMKLGRAPQFARGDEKTQDALTVQFTEKGGMPKDKMLEGESAVIGVEQPENTGKRAYGHFWERLGSASE
GHYARGTIQWHRDLPEDASMASARLVRKRTGCKMKYYMQYVINTAQIRQVSDHARKALLAVHMGWSADISGRRVCG
ITDAADPELAQIIQLPPEIERNIQRAANIQGKRDQARDEIAPKIRAFDGSLPPEWDESTQDYWSHWKVLPANHMAA
SRIHAWRKRLGDFAPEWMAEWCKADRMLWIAATHTAQRARNRRKDFYRNLAKTWASQYEAIVIEKPDIKKAAKILD
EATGERTEFAKKARAGRVLASLYTLDSAIRWACQKNGTAILDMNGEKTAATCAMCASEAIRADTEDGQVLHCADCG
AVLDRKKNGAAVAWQLVNEQRENLVEEYWAEQLNKEREAAEAKASRLEKMQAARRAKREPALAD (SEQ ID NO:3)

>JMEB01000165_11
[*Acidithiobacillus thiooxidans*]
MNLKVCGDIDDQIRRARAMYNNIIAVMRGIYDEMQTFTMEHAGPEGQALHEKIVAANVAFDAAKADNDEPRMKQIA
MERRELWKALSIILKEVRKEHKNTLKERFYSRIGNNSSTETYQCRAEAIVGGLGYATATKVLDNALKAWQMSMVKG
KAPRFARGEEKDQDTLTLQFSQAGGVPVEDIFTGKRKDIGIEYPKKGEGPRSYSAFRFRLGAASEESYAEGTVQLH
RAIPENARIAMAHLTRKKAGRKYQYELQLLATLAEPINLLPDHRRKPLVAIHFGWSGDEEGRRLAGIADNADPLEA
RLLTLPPDIEDDIREASALQAKRDTYRDEVFLRLKEENTLPTKGETPLSEHWNKIRKLPAQHVSANRMHHLAWLVK
SELIEIPEWEETWRKADQRMWVQATSLARRARNRRKKYYEKVAIDLASRYEAILIEMPDLKKSAEKVNEKTGEKTE
FAKKARSGRVIAALYVLESAIQWAACKHGSAVLKIKGEKTASVCAFCEGDHLEEKEEHDSQTLYCPDCGSTVDRKL
NGAANAWKRAASDLESLVTEYWEETREKQMGKAETKRLKSEKMAEARRLKRQAASQASAGA (SEQ ID NO: 4)

>WP_051690567.1
[*Acidithiobacillus thiooxidans*]
MSQIKIVPQINGSQLVYKYGVRMNLKVCGDIDDQIRRARAMYNNIIAVMRGIYDEMQTFTMEHAGPEGQALHEKIV
AANVAFDAAKADNDEPRMKQIAMERRELWKALSIILKEVRKEHKNTLKERFYSRIGNNSSTETYQCRAEAIVGGLG
YATATKVLDNALKAWQMSMVKGKAPRFARGEEKDQDTLTLQFSQAGGVPVEDIFTGKRKDIGIEYPKKGEGPRSYS
AFRERLGAASEESYAEGTVQLHRAIPENARIAMAHLTRKKAGRKYQYELQLLATLAEPINLLPDHRRKPLVAIHFG
WSGDEEGRRLAGIADNADPLEARLLTLPPDIEDDIREASALQAKRDTYRDEVFLRLKEENTLPTKGETPLSEHWNK
IRKLPAQHVSANRMHHLAWLVKSELIEIPEWEETWRKADQRMWVQATSLARRARNRRKKYYEKVAIDLASRYEAIL
IEMPDLKKSAEKVNEKTGEKTEFAKKARSGRVIAALYVLESAIQWAACKHGSAVLKIKGEKTASVCAFCEGDHLEE
KEEHDSQTLYCPDCGSTVDRKLNGAANAWKRAASDLESLVTEYWEETREKQMGKAETKRLKSEKMAEARRLKRQAA
SQASAGA (SEQ ID NO: 5)

>OJW42488.1
[*Rhodanobacter sp.* 67-28]
MKITPASLPQGDVRIYEFGARLDKDCLEAANDQFFKAHQLYNELVACMQGTLRDMQAYLLENAGQEAQSAQARVEA
LNEALSAAKAANDEDTMKAVASERREVWRTLAALLRDTRKVHKATLQERFLCRIGRKSTCATYQLRCDAVAAGLGW
ATANATLDAALLAFKSSFVQGRAPRFAKAGESTQDSLTLQFTAAGGVSVSTLLEGRHTEFRVKASGGCGPRRYGTL
EFRLGPASSETYAAGTWQYHRAMPDDGAVGLVRLVRRRLGPKFQWAIQFQVRSPLPVNDSVGERKPLVALHAGWAA
DLTGRRVAGIADGADPGLARVLQLPPEIEAGLQHSGEVESARSVARDNVVATLKAHAWPQDLLDAAEQPTEDATPE
ATRRSQAAADLLVIRRLPATHVAIRRLHRLAQRLRDTADLPDWFEAWRKEDKLAWQKAAHAAKRARNRRKGFYREV
ALGLATGYQAIVLQPLDLESAAKKVDDASGERTEFGRKARSGRVVAAIYELEGAIRWAAAKCGTAVLELTGETAGH
CAYCGGAVKPVEDDSQRLACTQCGADIDRKRNGAALAWQATEESLPTLVEDFWRETLAARDGAAAKRKEKREKVAE
ARRASRVVE (SEQ ID NO: 6)

>LNFM01018448_6
[activated carbon metagenome]
MTMEQAMVGAVYESASAAGEEVMASRNETTQEETDAFSVSFSTVGPAEVMVYEFGCRIAKGDLDHLRDQLWRSRRL
FNEVAAQINQTVDEAKCELSDRAGPVAGEIAVRLGVLDTEWKSAKALDDREALVKIAGERKSLRTRWYGLLHKARR
EHGTELRERYLSRIGNRVGAATYALRCAAVDDGLDWAMGNEALAAALGAFGKQWPRFKPISFRREDDPTEVATLQF
TAAGGVAVADILADKHSQIGMQLGREQAGRRMYVPFRMKLGSGAQKKAITGTVLYHRPLPAGASVPIARLVGRRIG
KDVKHYLQFMVKLKQAEQPGANSKRAPMGVAHLGWYYQPTGRRLAEVASSEDPGLSEQLTLPIEVAELLDRARELD
GQRSKLRDGIVGSVVRELPVEGAPEQIAEEVAALRKMRIEHVAPRRLGKLVFIWSRNCADWQRDRLKAMQAWRLED
RMLWQSSAHTARRARNRRRKHYEQLALSLAGKFTNILIDVPDLAQVAKVKDEDTGEHNGLGARARGGRFDAALYEL
TSAIEKAGARLGCNVGKIKGPTASTCAHCGGTTKMGKTVRDVVCEACGAVEDRAASAAAVAFGWASQNKDAVDEAV
AAALDADRAKATRAAERKEKMAIARATSRAARTESDEDSADGSRELK (SEQ ID NO: 7)

>3300004774|Ga0007794_10001723_8
[aquatic-freshwater]
MTIKVYKFGLLDPVSGWDQTAIDVLFLRNKLWNNLVAMEHDKRQAYRNLLLDSDTELAALQARLDAIEVEKASLIT
SKKALRAKARSRQVDTAEIDLEIKKLLEERKALGGQTKDLRERVKIEVKPLAAELDQQRYEKTKQLNKESGLWWCN
SMTVIAAYEVGRLRAMREKNELRFHGEDGTGKYSVCRTGGESLDHVMTGKLSEVSIRTLPIANLDDLSERGQRSRA TABLE 2-continued Amino Acid Sequences of Representative CLUST.018837 Effector Proteins*

RHHLTMIVLRATTEEGTKIRHEVTWPIILHRPLPDDCLIKQIQVLRKRVGDRFEWTCSITVDTPEELKARLDSPSI
SVCGIDLGFRQVNNDLRVATLADSSGGLRYYTIGKDWLDSMDYVEAIQSDLSGTANSVWAQLRLILKELDEYPEAL
RERITDMLKAGAKTPIRAMRAMQKTLSNEPDLMPDALALLDDWKKRIRRRTKEMHDLRDKLINRRKDIYRNIACEI
ARDYSLVRIANLKLKDMVKLKRNDGTDTKLTDNARKNCNRAALSELTLYIQQACAKNGVALEKIDTTYMTRTCYQC
GYLNPANTINLLLSCEGCGAEYDQDDNAAKNYLNATKPGTG (SEQ ID NO: 8)

>3300004776|Ga0007800_10001775_2
[aquatic-freshwater]
MTIKVYKFGLLDPVSGWDQTAIDVLFLRNKLWNNLVAMEHDKRQAYRNLLLDSDTELAALQARLDAIEVEKASLIT
SKKALRAKARSRQVDTAEIDLEIKKLLEERKALGGQTKDLRERVKIEVKPLAAELDQQRYEKTKQLNKESGLWWCN
SMTVIAAYEVGRLRAMREKNELRFHGEDGTGKYSVCRTGGESLDHVMTGKLSEVSIRTLPIANLDDLSERGQRSRA
RHHLTMIVLRATTEEGTKIRHEVTWPIILHRPLPDDCLIKQIQVLRKRVGDRFEWTCSITVDTPEELKARLDSPSI
SVCGIDLGFRQVNNDLRVATLADSSGGLRYYTIGKDWLDSMDYVEAIQSDLSGTANSVWAQLRLILKELDEYPEAL
RERITDMLKAGAKTPIRAMRAMQKTLSNEPDLMPDALALLDDWKKRIRRRTKEMHDLRDKLINRRKDIYRNIACEI
ARDYSLVRIANLKLKDMVKLKRNDGTDTKLTDNARKNCNRAALSELTLYIQQACAKNGVALEKIDTTYMTRTCYQC
GYLNPANTINLLLSCEGCGAEYDQDDNAAKNYLNATKPGTG (SEQ ID NO: 8)

>3300009004|Ga0100377_1000348_44
[aquatic-freshwater-aquifer]
MTNQENFSIKAAKTPSGDVLIYEFGARLDKECAAEVDKQIKQARGLYNNIVALMRDTMDEMRADLVENAGPVARET
QAAIDALNLKFAEAKARDDEGAMLLIAQQRRELWAQLSALLKEVRASLKSEHKSRFFSRIGINSSCATYQLRSVAV
KEGLGWGTANEILDNVLGAWKKSLAMGKAPREVSAAEKMQDTLTLQFTAAGGISVVDLLSRSKGDMILTPPSEAGK
RKYGSFQFRMGAASSNSYATGTWQYHRPLPEGSSVGVARLIRRRVGKDTKYAIQLQVKIKEGIEQAVRNRKPLATV
HFGWAGDVEGRRVAGIADSAEPSSAQVIALPTEIEEMLARSTTIQGERDTERDNIVPVVKQLDPTKEDETLAEEVT
ALNKLPAQHIAIRRLHRLCRHLGDVDMLPEALAEWRKADRMRWQSETHLARRARNQRKDFYRNIAINLARNYEVIA
IEPLDLAKAAIKLDKMTGEKTELSKKARSGRVVAAIYELESAIRWAAVKTGAAVLELTAAKTASVCSICGGHVSDD
TENSQILHCDDCGADLLDRKQNGAAIAWQMVEPLREDLAVDYHQAKIDAARATKQKMVEKLGKLAEGRLKGREAKAG
SAANPE (SEQ ID NO: 9)

>3300004236|Ga0066449_1000007_83
[aquatic-freshwater-freshwater sediment]
MINCYKFGCLQPTAGEDQSAIEHLFLRNKLWNTLVALDHEFRQYRYRDLMLNSDEKLKSVQDSIDSINQEIEDLVEN
KMKLRQKERTKNIDSKLLDERINVLKAKRKTLSADSKTERERVKVEIKPQIDLLNTERYEAKKLAYKESGLWWGNY
ETVVAAYDTASQKAMKSNTELREKSEDGSGKFAVRFEDGGLTIDELKAGASNLCRIETLNTSAFQNLSQRSIKSKA
RHSLTMTIYTENDEKGKKQRKEITVPIIEHREMEEGKIKTIHLQRKRLGNQFTWSASFTLKNDIEPANVADHPATA
SCGIDLGYRLVKDGLRVATVADSQNNVEYLVLPKSWIDRMDYTETLQSGLSEAMTLMWAKLKAEIAKIPEYPDAVA
EIIKNMQKMGDRLPYKGIKRLYRVLKEQDATGSPVAGENAVLDILKAWDKATYRQELEMVNLKDKLLKQREHIYRN
FAAGLTKKYAHIVVEDMGLAELAKTEKSETETNDMPNAVKANRQRASLYSLVEAIRLSAAKVGSYFEKSKAAYSSM
TCNVCGHLNPKTQNIHQSCESCNTMYDVDENAARNFLKGEYINEKVLKQG (SEQ ID NO: 10)

>3300009432|Ga0115005_10004282_5
[aquatic-marine]
MATRVYKYGLIPIGYPPQAAIDELFRANSLKNTLVALHRESRENWDDARRSASILYSEKMDELDKKNEDITEAFNG
LNKARMDEGTKDETGNKRLLAERAIINRLKKEKGDIYAELKPRKEADKSIDKKALNDAYRQKCNDAVSAKVSGVY
RRTAEQIYANEKTAKDKASKDNATLQFHREDGTGYFQFRCNPKGVSTDGISVDAFMSANEDGYMRCAVQSVDNSKK
KPRIRINAVLAGGRTKASKVFQEFDWIYHRPLPADAQIQNGKILRTRVGDKFRYDLVLTIRVPDVEMVQPAKLSGT
IGIDVGFRKVGNTLLIGTVMSSDRSQKAVALEVPQMMVSALEHVVALQGELDDAASDLGKAITPLLKANPIDDEHS
KYRLWRSLALRPLHVTLSFEQAYKLSLWLKHEPSLEPSEINLKVHTWWRSYSRKYREIHNRRKKQLTHRKHEYRET
AAKLVAENKLIVLEDINLTDFAETKSKNTKLSNKARAQRFMASLGEFRDAIKNAAGREGVPVIDVNPAYTSKTCSD
CGHLNKELRSEKEWTCPACGVVHDRDENAANNLQKMGQKYLLDVQKAASMVVQ (SEQ ID NO: 11)

>3300009436|Ga0115008_10017733_3
[aquatic-marine]
MTTRVYKYGLIPIGYPPQVAIDELFRANNLWNTLVALHRESRENWDDARRSASILYSEKMDELDKKNKDIREAFNG
LNQARMDEGTKDETGNKRLQAERAIINRLTKEQKEIYAELNPLRKEADKTVDKKALNDEYRKKCNTAVSAKVSGVY
SRTAGELYAYFRTARDKAFKDKTTLRFHRFDGTGYFAFRCRSKAVGVNVDGISVEDFMSQGFMDYMRCAVMSIDES
KKKPRILISAVLTGGATKASKVVQEFDWIYHRPLPPEGQIQNGKILRTRVGDKFKYDLVLTVKLPDVEMIQPAALN
GTIGIDVGFRKVGNSLLIGTVMFSDSAQKAVALEVPTMVVSALEHVDALRSELDDVASDLGKAITPLLKANPIDEE
HDKYRLWRSLALRPLHVTLSFEQAYKLALWLKREPNLFPSEINEKVHTWWRSYSRKYREIHNRRKKQLTHRKHFYR
ETAAKLIAQNKLIVLEKIDLTDFAETKNKNTKLSNKARSQRFMAALGEFRDAIKNAADREGVPVIDVNAAYTSKTC
SECGYLNKELKSEKEWNCPECGVVHDRDENAANNLQKMGQKYLLDAAKTAVVVK (SEQ ID NO: 12)

>3300009436|Ga0115008_10017733_4
[aquatic-marine]
MAIDELFRANNLWNTLVALHRESRENWDDARRSASILYSEKMDELDKKNKDIREAFNGLNQARMDEGTKDETGNKR
LQAERAIINRLTKEQKEIYAELNPLRKEADKTVDKKALNDEYRKKCNTAVSAKVSGVYSRTAGELYAYFRTARDKA
FKDKTTLRFHRFDGTGYFAFRCRSKAVGVNVDGISVEDFMSQGFMDYMRCAVMSIDESKKKPRILISAVLTGGATK
ASKVVQEFDWIYHRPLPPEGQIQNGKILRTRVGDKFKYDLVLTVKLPDVEMIQPAALNGTIGIDVGFRKVGNSLLI
GTVMFSDSAQKAVALEVPTMVVSALEHVDALRSELDDVASDLGKAITPLLKANPIDEEHDKYRLWRSLALRPLHVT
LSFEQAYKLALWLKREPNLFPSEINEKVHTWWRSYSRKYREIHNRRKKQLTHRKHFYRETAAKLIAQNKLIVLEKI
DLTDFAETKNKNTKLSNKARSQRFMAALGEFRDAIKNAADREGVPVIDVNAAYTSKTCSECGYLNKELKSEKEWNC
PECGVVHDRDENAANNLQKMGQKYLLDAAKTAVVVK (SEQ ID NO: 13)

>3300001351|JG120153J14318_10007490_6
[aquatic-marine-pelagic marine]
MATRVYKYGLIPIGYPPKETIDELFKANVLWNNLVALHRKNREDWDDARRAASILYSDKIDELEKKEEDLDAAWKA
FQQARMDEGTRDETNNKRLKSERASINRLKAERAEIYKELKPLRKEADKEIDKKQLNDSFRAQVNEALSVNNSGVY
RAIADQIYENFKTAKDKSIKENATLRFHRFDGTGYYHFRCRRKGTNVDGISIDDFMSRNFEAYPRCAVQNIDNSKK TABLE 2-continued Amino Acid Sequences of Representative CLUST.018837 Effector Proteins*

KPRIRINAVLAGGKSKASKIHQEFDLIYHRPLPIDAQIQNGKILRTRVGDKFKYDLVLTLKIPDKEPISYNNLKGT
IGIDIGFRRSVNSLLIGTVMSSDVTEEAYEIIVPPKIVEAFEHVIDLKSDDDAATDLGRIITPLLKAHPLDEDHS
KYKMWRSLALRPAHVTLSFEQAYKLAIWLKHEPDTFPEEITKKVHTWWRSYSRKYRELHNRRRNQLTHRKHFYREE
AAKIVALNKLIVLEEINLTDFAETKEKNTKLSKKARAQRFMASLSEFRDAIKNAAQRDGIGIIDVNPAYTSKTCSE
CGNLNKDLRSEKQWSCPACGVVHDRDENAANNLQKMGQSYLENIKKETSEIIE (SEQ ID NO: 14)

>3300009447|Ga0115560_1022222_2
[aquatic-marine-pelagic marine]
MATRVYKYGLIPIGYPPKETIDELFKANVLWNNLVALHRKNREDWDDARRAASILYSDKIDELEKKEEDLDAAWKA
FQQARMDEGTRDETNNKRLKSERASINRLKAERAEIYKELKPLRKEADKEIDKKQLNDSYRAQVNEAISVRNSGIY
NATAGQVLDNFKAARDRSFKENATLKFHRFDGTGYYHFRCRRRGAKVDGINVEDFMSRNFIANPRCAVQSIDNSKK
KPRIRINAVLAGGQSKASKVHQEFDLIYHRPLPIDAQIQNGKILRTRVGDKFKYDLVLTLKIPDKEPISYNNLKGT
IGIDIGFRRSVNSLLIGTVMSSNVSEKAYEIKVPPKIVEAFEHVIDLKSELDDAATDLGRIITPLMKAHPLDEDHS
KYKMWRSLALRPAHVTLSFEQAYKLAIWLKHEPDTFPEEITKKVHTWWRSYSRKYRELHNRRRNQLTHRKHFYREE
AAKIVALNKLIVLEEINLTDFAETKEKNTKLSKKARAQRFMASLSEFRDAIKNAAQRDGIGIIDVNPAYTSKTCSE
CGNLNKDLRSEKQWSCPACGVVHDRDENAANNLQKMGQTYLESLKKETSEVIE (SEQ ID NO: 15)

>3300009505|Ga0115564_10016546_3
[aquatic-marine-pelagic marine]
MATRVYKYGLIPIGYPAKETIDELFKANVLWNNLVALHRKNREDWDDARRAASVLYSDKIDDLEKKEEDLDAAWKA
FQQARMDEGTRDETNNKRLKSERASINRLDTEKAEIYKELKPLRKEADKEIDKKQLNDAYRTKVNEAVSVRNSGIY
SATAGQILENFKTARDRSFKESATTLRFHRFDGTGYYQFRCRRKGTNVDGISIDDFMSRNFEANPRCAVQSIDNRK
KKPRIRIDAVLVGGQSKASKIHQEFDLIYHRPLPIDAQIQNGKILRTRVGDKFKYDLVLTLKIPDKEPISYNNLKG
TVGIDIGFRRSVNSLLIGTVMSSDVTEKAYEIKVPPKIVEAFEHVIDLQSELDDAATDLGRIITPLLKAHPLDEDH
NKYKMWRSLALRPAHVTLSFEQAYKLAIWLKHETDTFPEEITKKVHTWWRSYSRKYRELHNRRRNQLTHRKHFYRE
EAAKIVALNKLIVLEEINLTDFAETKEKNTKLSKKARAQRFMASLSEFRDAIRNAAQRDGIGIIDVNPAYTSKTCS
ECGMLNKDLKSEKQWSCPACGVVHDRDENAANNLQKMGQTYLESLKKETSEVIE (SEQ ID NO: 16)

>3300020165|Ga0206125_10004811_3
[aquatic-marine-seawater]
MWCEINMATRVYKYGLIPIGYPPKETIDELFKANVLWNNLVALHRKNREDWDDARRAASILYSDKIDELEKKEEDL
DAAWKAFQQARMDEGTRDETNNKRLKSGRASINRLDAEKAEIYKELKPLRKEADKEIDKKQLNDAYRTKVNEAVSV
RNSGIYSATAGQILENEKTARDRSEKESATTLREHREDGTGYYQFRCRRKGTNVDGISIDDEMSRNFEANPRCAVQ
SIDNSKKKPRIRIDAVLVGGQSKASKIHQEFDLIYHRPLPIDAQIQNGKILRTRVGDKFKYDLVLTLKIPDKEPIS
YNNLKGTIGIDIGERRSVNSLLIGTVMSSDVTEKAYEIKVPPKIVEAFVHVIDLQSELDDAATDLGRIITPLLKAH
PLDENHSKYKMWRSLALRPAHVTLSFEQAYKLAIWLKHEPDTFPEEITKQVHTWWRSYSRKYRELHNRRRNQLTHR
KHEYREEAAKIVALNKLIVLEEINLTDFAETKEKNTKLSKKARAQRFMASLSEFRDAIRNAAQRDGIGIIDVNPAY
TSKTCSECGMLNKGLRSEKQWSCPACGVVHDRDENAANNLQKMGQSYLESVKKETSEVIE (SEQ ID NO: 17)

>3300010313|Ga0116211_1004493_2
[aquatic-thermal springs-hot spring]
MIKAFKYGMLEPVAGEDKAAIDVLYLRNKLWNSLVELEKAHRERYRTLITGSDDELSKIQARLDQIEAERAELVKR
KRQARAMVRSKKVDTSEHDRIDMLMAERNDLRTKAKDIRLQVKEKVKPAIADLEKERYEAVKHLIHEAGLWWCNS
ETVIAAYDLARVKAMKENAELRERSEDGSGKFAVRKTGGFALSDLVSGKLSFARLEALPDANFAHLSERGKRSRAR
HHLTMTILTYKDESGKLCRHEVTWPIILHRPLPPEGMIKFIHVQRKRIGKDFQWTCSITMEVDEIQKTPIDHPSRA
ACGIDIGYRLVKDGLRVAVIADTSGKIDHLTLPQDWIEKMDHVESIQGHLDNSNDLAWGELKALLKSMHDYPESIA
ESIGRLLKAGDRTPVRGMRALHWRLRNEPETMPEVLSILDTWEAETCRREREMHRLRRKLINRRKDLYRNFAYKVA
NRYVLIRIRGLSLKKLAAVNLEDGSDNQMPQAVRNNRTRASLSELTLCLQQAAVKAGADFEKVEDVNSTTTCSTCG
NQNLKMDREDIYFRCEKCDTLHDQDENAAKNLLRKEFYLAEQAVM (SEQ ID NO: 18)

>3300009784|Ga0123357_10002363_9
[arthropoda-digestive system-termite gut]
MENHKFTIPDQANQGIIVYEYGIRLDKESKPLVWQQIQLSRKLYNNIVASMRQTFDAMNTFILERAGDEGKQLNQA
IEEGIEREKTAKAEQNEDDIKETVLFLREKRAKLSEQLKGVRTQYKEETKRNFENRIGMRTSCETYQIRSQAVKDG
LGWATANEVLNSALKAFQARIKTGQPPKFAVGEEKQQDSLRTQFTQAGGCPVATLFESEHSGLSLRAAAGFGRRKY
GTERFRLGEAKSDVWATGTCQFHREIPSGATVASAALVQRRIGRDLKHALQLVVKLPQQAEAQATQSKKFCTVHFG
WASEEGIQYVMALADQEMPTKAQLFQLPTDIETDENRVENLASQRSKLLNDLVLQIKSGSIVIPSQIKEVADEFDA
IKRLPATHISLTRLHRICRLMIESDIFRPEALERWRRQDRLLLQDIAHIRRRALYRRRDFYRVTASVIAKSYGAIV
IETLDLKKANTKINMVTGEKSDKNKKSRSRQRMAALHELQRQLRQAAGKAGCVIIELTGEKTTATCAFCNREGTTT
TSESSQVLHCPHCGSQMNRKQNGAAVAWQLASPIIDDLVHEARSLAAVQSSERAASKILKAEKVATARKANRAARE
PAATDK (SEQ ID NO: 19)

>ADIG01000806_20
[groundwater metagenome]
MIVQITPAPLPQGDVRIYEFGARLDHDCVRTVDEQIFKAHQLYNQLVACMQTTVRDMQAYLLDHAGPDAHAAKARV
DGLNEAFNAARAANDENRMTTVATERREAWRALAAVLRIARKEHRTAMQETELSRIGKKSACETYQLRCKAVADGL
GWATANATLDAALIAFKKSFALGRAPRFARIADSIQDTLTLQFTAAGGINIERLLDGKHTELALKPPAVCGKRGYG
TFAFRLGAASAETQATGTWQYHRPLPPGGTVGLARLVRRRIGPKTTWSLQLQVRSPLPEREHEDRRPLVTVHPGWA
ADLSGRRIAGIADAADPGLATVLQLPPDIEHGLQRAAELESTRSQARDALTPMLKVHPWPQELLNAATPEEDASAS
GDSGPMAPERIMCRKVADEILALRRLPAQHIAIRRLHRLARWLRLAEVDVPDWLETWRKEDKLRWQASAAAAKRAR
NRRRGFYRETALRLASQYQAIVIEPLNLADAAKKIDEATGERSDFAKKARAGRVVAAIFELDSAIRWAATKCGTAV
LDLTGETAQHCAICGGHSLKADDEDSQCLRCSDCGADIDRKRNGAALAWQAAAAHLETHLEDFWRLTLENRASAAA
KRDEKKTKLQEGRRAAMRETLET (SEQ ID NO: 20)

>CXWL01128655_18
[groundwater metagenome]
MIKAYKFGLLNPISGEDQAAMDVLYLRNKLWNQLVELEKNSRAAYRALMLDSSEELSVIQTRIDAIEVERADLVSQ
KKKLRASVRSKKVDTAGIDAAVERLIAERTNLRAKAKQLREVVKVEIKPKAVELDKVRYAAVLALIKGSGLWWGNS TABLE 2-continued Amino Acid Sequences of Representative CLUST.018837 Effector Proteins*

ETVIAAYDVARVRAMKESAELRERSEDGTGKFAYRESGGIDFDKFMSGKVNFARLNTLPDSDFAHLSERGRRSKAR
HHLTMTVLTSVDDAGKKVRHEVTWPIVMHRDMPAGAIKTIHVHRKRVGDQFNWTCSITIDVPEEPKQLIDHPAKAA
CGIDLGERLVKDGLRIATIADSDNRIEHVVLPLDWIEKMDYVEHLQSTLSETANLTWVRLRKHLSELPDYPESIKE
RIHNILKAGERVPTRGMRSLLGALKAEPELLPEALQILAAWSDDIYRPAREMHNLRDKLMKRRQDLYRNVSHCLSN
KYAMVRVEDMDLRQIARVKKDDGSDNPLPDTVRDNRKRAALFEFVLSIKQSCVKTGSVFEKMNPAYSSMTCSSCGH
LNQPGMDIHYSCENCGTLHDQDENAAKNFLRGEYFSSPKQDVA (SEQ ID NO: 21)

>OGCL01001770_13
[hot springs metagenome]
MIKAFKYGMLEPVAGFDKAAIDVLYLRNKLWNSLVELEKAHRERYRTLITGSDDELSKIQARLDQIEAERAELVKR
KRQARAMVRSKKVDTSEHDDRIDMLMAERNDLRTKAKDIRLQVKEKVKPAIADLEKERYEAVKHLIHEAGLWWCNS
ETVIAAYDLARVKAMKENAELRFRSFDGSGKFAVRKTGGFALSDLVSGKLSFARLEALPDANFAHLSERGKRSRAR
HHLTMTILTYKDESGKLCRHEVTWPIILHRPLPPEGMIKFIHVQRKRIGKDFQWTCSITMEVDEIQKTPIDHPSRA
ACGIDIGYRLVKDGLRVAVIADTSGKIDHLTLPQDWIEKMDHVESIQGHLDNSNDLAWGELKALLKSMHDYPESIA
ESIGRLLKAGDRTPVRGMRALHWRLRNEPETMPEVLSILDTWEAETCRREREMHLRRKLINRRKDLYRNFAYKVA
NRYVLIRIRGLSLKKLAAVNLEDGSDNQMPQAVRNNRTRASLSELTLCLQQAAVKAGADFEKVFDVNSTTTCSTCG
NQNLKMDREDIYFRCEKCDTLHDQDENAAKNLLRKEFYLAEQAVM (SEQ ID NO: 18)

>LNAP01002847_16
[soil metagenome]
MKKITIRKYGARLLGDSEPIIVKSMRDQNTLWNKLVEIERANTTEYRDIVAQSDDVLAALTQEYAAAEQRLKDVQE
MRNRVRAAKRSKQIEGAENYAAEIKAISSSLKDLRARMKECRARAKEAAKPRLEGLEDRRRAAVKQATNEAAIWWA
HSELVTNSFDVARVKALKSNAELRFHRFEGEGRIGVRIQDGLLPQVREATPEELGHLQAQRARKRLV
AVDIRVGKRGEDGHIPKATFLVTIHEGMELLPNTPLKTVTVKREMHAGQPKWFMVFMFVESDAEPEDKPLPPKAVG
VDFGWRVVKDREWGERTGLRVATIANKDGTKQHITLPPELLARFERSTRLRSELDVAANEFWVRTASLFTDDILAT
LSEDEWLRVLVGKAKRAHRPYPSLMEAITRAHAANPVLGPEADEQMQAWARRARRLNVAAFGARRKAADHRKHLYR
NVAARLVRECGLIAIKDTDFHKLAKLVDDDGKETELNKHARANREMASPSELRQAIKMAALREQRELVNVAPAHTT
TTCSACGHVHGERPKDLIFVCDSCGKWHDQDENSAAICLKIALESKL (SEQ ID NO: 22)

>3300007533|Ga0102944_1000048_72
[terrestrial-soil-pond soil]
MNDVTLSFRGLEPRESTSWSYGARVAGSEALEEQYTLAQRTYNNMVEVTRQALAAFNEWFAEKDPEIARLGTEIER
LGAQWAEAKARDDRDELARIAAERRPLRQQWYERCFAVRKDNRGEVNALLKQWVGSAKESRLYLARVEAVKAGLYW
ATATAVMTAVQRAWDKQFPRLRPVAFSRRSEKRRETLVVQFTESGGVAMETLHTKHGGLWIEPPGEGLLSAWANGR
RPGRPDRYLRFRMRIGGRGREGVYVEGSVQMVRPVPEGARVMMARLVRERVATRYRYQLQLVLRLAEPLSIPAEDK
APRVALDIGWYYEAGRGRRVIAYTAGANEDAVEQIYLDPSIDEAFDRVDDMSNRRSLARDDVTIALRCCQWDGAPE
ALAEALSAINRLPVAHVSPARLAQMVWLWREHHGDYRPDVLEELWAWRRWDKKLYETSAHLRRRTAGRRKKEYEGW
ARHFASRYATIVVVRPDLREAAMVKNAISGEHTALTARARQGRVRAALYEFLNVVATKAAEAGSVVIELTGRTTTE
CSACGEIMVVPEDNPATRLLVCHACGVSHDREANSAVLAFRVLDDEASVTKGLAHAQEKADKARERRYKRRTAMRD
ARWKDEQTTTSGQ (SEQ ID NO: 23)

>3300007533|Ga0102944_1003721_10
[terrestrial-soil-pond soil]
MNQSPPANGECMENVTLSFRGLEPRESTSWNYGARVEASEALEEQFTLAHRTYNQMVEVTRHALAALTDWFCEKDP
EIARLGAAIERLSAQWSEAKARDARDELEQIAAERRFLRKDWYERCFAVRKDNRSEVNALIRQWVGLTKESRLYAV
RTEAVKAGLYWASATAVMTAVQQAWDKQFPRLRPVAFSKRAEKTRETLVVQFTEAGGVPMSTLHSKHGGLWIEPPG
DGLLTAWANGRRPARPDRYLRFRMRIGGRGREGVYVEGSVQMVRPVPEGARVMMARLVRERVATKYRHQLQLVLRL
AEPLSIPTETKEPRVALDLGWYYEAGLGRRVIAYTGGDNEDAVEQIYLPPGIDEAFDRVDDMNSRRSLARDDVAIT
LRCCQWDDAPAPLAETLAAINKAPVAHVAQARLARLVWQWRNEHSDYRPDVLAELWSWRRWDKKLYEASAHLRRRT
AGQRKKEYEHWARYFASRYTTIVVVRPALREAAVIKNEASGEHTALTARARQGRVRAALYDFLNAVATKAAETGSV
VIEVSGRTTTECSACGAIMAVPEENPATRTLVCHACGVSHDREANSAVLAYRVPDDDGAVTQSLEHAQEQADRARE
RRERRRQAMREGRWKGKQSAGGGD (SEQ ID NO: 24)

>3300007533|Ga0102944_1003721_8
[terrestrial-soil-pond soil]
MENVTLSFRGLEPRESTSWNYGARVEASEALEEQFTLAHRTYNQMVEVTRHALAALTDWFCEKDPEIARLGAAIER
LSAQWSEAKARDARDELEQIAAERRFLRKDWYERCFAVRKDNRSEVNALIRQWVGLTKESRLYAVRTEAVKAGLYW
ASATAVMTAVQQAWDKQFPRLRPVAFSKRAEKTRETLVVQFTEAGGVPMSTLHSKHGGLWIEPPGDGLLTAWANGR
RPARPDRYLRFRMRIGGRGREGVYVEGSVQMVRPVPEGARVMMARLVRERVATKYRHQLQLVLRLAEPLSIPTETK
EPRVALDLGWYYEAGLGRRVIAYTGGDNEDAVEQIYLPPGIDEAFDRVDDMNSRRSLARDDVAITLRCCQWDDAPA
PLAETLAAINKAPVAHVAQARLARLVWQWRNEHSDYRPDVLAELWSWRRWDKKLYEASAHLRRRTAGQRKKFYEHW
ARYFASRYTTIVVVRPALREAAVIKNEASGEHTALTARARQGRVRAALYDFLNAVATKAAETGSVVIEVSGRTTTE
CSACGAIMAVPEENPATRTLVCHACGVSHDREANSAVLAYRVPDDDGAVTQSLEHAQEQADRARERRERRRQAMRE
GRWKGKQSAGGGD (SEQ ID NO: 25)

>APMI01033782_24
[wastewater metagenome]
MKSTPDTISITPGATANGDMLTYEYGLRLDKESIAHVGAQIAMSRRLYNDLVAQIRTTVDALQAFVIDKAGDEAVQ
IKVRIEELTTNEKAAKAEDNEPEMKRIAEDRRNQWKLLSALIKAASKANRAEINERFLSKIGKNSSCPTYQLRGKA
VAEGLGWGTANAVLDAALQAFKTSFALGRAPRFASGAEIDQDCLFLQFTAAGGVASASLLAGKQADLQLLPTNGCG
KRKYGEFKFRLGAAKADTYATGTWQYHRPLPDGSNIALARLVRRIGMHDKWAIQLLVKPKTPIRESVEERKPLVA
VHFGWAADIAGRRVAAIADAADPGAATILALPPSIEEALDRAREIQGVRDKSRDEIAPQVRSIEIPGSANETLIDL
LGRVRKTRPQDISANRIHYLCRLLREADHLPDWLEAWRKEDKNRWQDAHIAKRARNARKSFYREVAINLGRQYDA
IAIEPLDLASAAMKVNEATGEKTDFAKKARAGRVVAALYEFESAIRWAATKTAAALIEVSGATASVCSVCGGHVEA
TKDDHQSIVCHDCGAVLDRKQNGAAIAWQSANDKREDVVTEFWSEYFADSEAKKEKKAEKLAKMAEGRRNARTESA
AEIA (SEQ ID NO: 26)

TABLE 2-continued

Amino Acid Sequences of Representative CLUST.018837 Effector Proteins*

>NZ_JQKL01000024_23
[*Clostridiales bacterium* DRI-13]
METAATKNYLALSEGCLSPTRGEEYLLDQIKKKHDLWNKLVEKDREHREKVRQVMVFESETTKKIKELEEELNSLR
EEIKNQRKTKRTGKVDLTDQKARIEEIKPQLKQLKEKEKEERSFIFEARKQELAQLEKERWAVVKELGKGSGLYWC
NLEDVVNSYDIGRKKAKAAGGEMREHRWDGTGKVTVREQKGLPVNEMESCTNNLLQIDPVDKDAWYNPVRAIRRKK
SRTRVRLRACSENKKPLFIELPVVLHREIPEDALIRTASVIREKVGMRYRYKLNLVLEILGENTNRILPALEGTAA
IDLGWRTVKDGLRVACLVDDKGHSEELILDNDVLHEENKIKDLQSIRDNLFNETKAKLMELLKTLELPDEAKERTS
HMANWRSQQKMLRLHQYWRENRLPGDDEVWEVLEYWRKREIHLYEWQENLRDQVLRRRKEIYRIFAAKITRKYKTI
VLEEFTLNKTVQKPNPEEGPAGTLPANRNRFIAAISEFRNELANACRKNHVEFTYVPAENTTITCHKCGHKEKFDA
AAQIIHTCSTCGELWDQDYNAAKNLLAFSQKGGVK (SEQ ID NO: 48)

>WP_081908191.1
[*Clostridiales bacterium* DRI-13]
MSRLEARTRYLQAGQKRLGKIRKRGFEMETAATKNYLALSEGCLSPTRGEEYLLDQIKKKHDLWNKLVEKDREHRE
KVRQVMVFESETTKKIKELEEELNSLREEIKNQRKTKRTGKVDLTDQKARIEEIKPQLKQLKEKEKEERSFIFEAR
KQELAQLEKERWAVVKELGKGSGLYWCNLEDVVNSYDIGRKKAKAAGGEMREHRWDGTGKVTVREQKGLPVNEMES
CTNNLLQIDPVDKDAWYNPVRAIRRKKSRTRVRLRACSENKKPLFIELPVVLHREIPEDALIRTASVIREKVGMRY
RYKLNLVLEILGENTNRILPALEGTAAIDLGWRTVKDGLRVACLVDDKGHSEELILDNDVLHEENKIKDLQSIRDN
LENETKAKLMELLKTLELPDEAKERTSHMANWRSQQKMLRLHQYWRENRLPGDDEVWEVLEYWRKREIHLYEWQEN
LRDQVLRRRKEIYRIFAAKITRKYKTIVLEEFTLNKTVQKPNPEEGPAGTLPANRNRFIAAISEFRNELANACRKN
HVEFTYVPAENTTITCHKCGHKEKFDAAAQIIHTCSTCGELWDQDYNAAKNLLAFSQKGGVK (SEQ ID NO: 49)

>GAB36148.1
[*Gordonia otitidis* NBRC 100426]
MTRVTVQTAGVHYKWQMPDQLTQQLRLAHDLREDLVTLEYEYEDAVKAVWSSYPAVAALEAQVAELDERASELAST
VKEEKSRQRTKRPSHPAVAQLAETRAQLKAAKASRREAIASVRDEATERLRTISDERYAAQKQLYRDYCTDGLLYW
ATFNAVLDHHKTAVKRIAAHRKQGRAAQLRHHRWDGTGTISVQLQRQATDPARTPAIIADADTGKWRSSLIVPWVN
PDVWDTMDRASRRKAGRVVIRMRCGSSRNPDGTKTSEWIDVPVQQHRMLPADADITAAQLTVRREGADLRATIGIT
AKIPDQGEVDEGPTIAVHLGWRSSDHGTVVATWRSTEPLDIPETLRGVITTQSAERTVGSIVVPHRIEQRVHHHAT
VASHRDLAVDSIRDTLVAWLTEHGPQPHPYDGDPITAASVQRWKAPRRFAWLALQWRDTPPPEGADIAETLEAWRR
ADKKLWLESEHGRGRALRHRTDLHRQVAAYFAGVAGRIVVDDSDIAQIAGTAKHSELLTDVDRQIARRRAIAAPGM
LRAAIVAAATRDEVPTTTVSHTGLSRVHAACGHENPADDRYLMQPVLCDGCGRTYDTDLSATILMLQRASAATSN
(SEQ ID NO: 50)

>BAFB01000202_4
[*Gordonia otitidis* NBRC 100426]
MPDQLTQQLRLAHDLREDLVTLEYEYEDAVKAVWSSYPAVAALEAQVAELDERASELASTVKEEKSRQRTKRPSHP
AVAQLAETRAQLKAAKASRREAIASVRDEATERLRTISDERYAAQKQLYRDYCTDGLLYWATFNAVLDHHKTAVKR
IAAHRKQGRAAQLRHHRWDGTGTISVQLQRQATDPARTPAIIADADTGKWRSSLIVPWVNPDVWDTMDRASRRKAG
RVVIRMRCGSSRNPDGTKTSEWIDVPVQQHRMLPADADITAAQLTVRREGADLRATIGITAKIPDQGEVDEGPTIA
VHLGWRSSDHGTVVATWRSTEPLDIPETLRGVITTQSAERTVGSIVVPHRIEQRVHHHATVASHRDLAVDSIRDTL
VAWLTEHGPQPHPYDGDPITAASVQRWKAPRRFAWLALQWRDTPPPEGADIAETLEAWRRADKKLWLESEHGRGRA
LRHRTDLHRQVAAYFAGVAGRIVVDDSDIAQIAGTAKHSELLTDVDRQIARRRAIAAPGMLRAAIVAAATRDEVPT
TTVSHTGLSRVHAACGHENPADDRYLMQPVLCDGCGRTYDTDLSATILMLQRASAATSN (SEQ ID NO: 51)

>WP_039994403.1
[*Gordonia otitidis* NBRC 100426]
MHYKWQMPDQLTQQLRLAHDLREDLVTLEYEYEDAVKAVWSSYPAVAALEAQVAELDERASELASTVKEEKSRQRT
KRPSHPAVAQLAETRAQLKAAKASRREAIASVRDEATERLRTISDERYAAQKQLYRDYCTDGLLYWATFNAVLDHH
KTAVKRIAAHRKQGRAAQLRHHRWDGTGTISVQLQRQATDPARTPAIIADADTGKWRSSLIVPWVNPDVWDTMDRA
SRRKAGRVVIRMRCGSSRNPDGTKTSEWIDVPVQQHRMLPADADITAAQLTVRREGADLRATIGITAKIPDQGEVD
EGPTIAVHLGWRSSDHGTVVATWRSTEPLDIPETLRGVITTQSAERTVGSIVVPHRIEQRVHHHATVASHRDLAVD
SIRDTLVAWLTEHGPQPHPYDGDPITAASVQRWKAPRRFAWLALQWRDTPPPEGADIAETLEAWRRADKKLWLESE
HGRGRALRHRTDLHRQVAAYFAGVAGRIVVDDSDIAQIAGTAKHSELLTDVDRQIARRRAIAAPGMLRAAIVAAAT
RDEVPTTTVSHTGLSRVHAACGHENPADDRYLMQPVLCDGCGRTYDTDLSATILMLQRASAATSN (SEQ ID
NO: 52)

>WP_013159911.1
[*Meiothermus silvanus* DSM 9946]
MPFGKKARHVKAYQFGADAPQEGMEAVLEQHRLRTDYYNALVEMELRQREERTALLANLAAESGLESPNQVYERLK
AAGEKGIRKHPEYVAARERQKALYGHPRLLELQSRQREERNALRRSFGAKGLYSSNYLDVERAFDKARQSPELRFR
RYSPHEGRLAVLYTEGLPMREIGSDTRVQLPLPDPIIYRDRATRRKHQRVLMKFRVRSVERQPLWITVPVYLHREL
PDGVCREVSLHWHRVADRLRWTVSVVVEVEGPPVASPTGRGAVAVDLGWRREGGLRAGFWVGEDGAGGEIALSEG
DLKQFSKVEDLRSIRDQHLNALKEALAAWLEAPPAPLPDWLAEETKTLPQWRSPARFAALFRRWQSERVHADEAAY
GLLEGWHKRDRHLWQYEANLREQMILRRREQYRVLAATLARQYDALIVEDFNLRAAAELDQGGSDLPDAARRYRTI
ASPSTLRDALVNAFAQRGKPVRKLNPAHTTTDCHACGGALVGDPAKELRLYCPTCERFYDQDENAARNLLRRAQEV
QAQV (SEQ ID NO: 53)

>WP_096876841.1
[*Methylomonas koyamae*]
MIRTYKYSLKAPENFAEDCEDELRRMNDLWNRLIEIDRQRERSFKDLCRSTSAEYAAAQDEIEALREPIDNLYDAI
RAERIATRSKEPSDELRARRDELLGRRKALWEICKAIQKAIPKESQAPINEVYKTNVKLARQQSGCFWGNYNAVIE
SPETAKSKAIKDGGRLHFKSFDGSGRFVNQIQGGMTVTELLSHSQAQLTNLVTTNKTKGRFAFTAFTGBDGAGK
RFRRQLFSEINYHRPIPADGVIKAVEVVKVPHDGKQKYKWHACFTVALPEVDIKHPKRNIAGVNLGWRQFGGRLRV
AVVVDDAGKKTEYFVPAELVSKFEAAETIQKAADDARNEMLSWLRTFYQDNRDEAPQEWRESIQGLLRNRPSVDAA
NHLMTIWRECVFAQEESRRYAAWLKSDAALRRSYTGCRQNAVKWREEIYRHIAKELAERYAVLAVTDTPLSTMSRT
KAKDDLAVDNALPESARRNRVIAAIYSLKEWIGKQAAKTGSTVETITGKMTATCHKCGYVAEKRLRGSQYATCKSC
GSELELDENAAINCRNHASGAVLISDKPEKTGREQRAKMAENDFARKIGDNASPLVT (SEQ ID NO: 54)

TABLE 2-continued

Amino Acid Sequences of Representative CLUST.018837 Effector Proteins*

>WP_048895525.1
[*Mycobacterium conceptionense*]
MAITVHTAGVHYRWTDNPPEQLMRQLRLAHDLREDLVTLQLDYETAKAGIWSSYPAVAAAETELADAESAAEQAAA
AVSEERTKLRTKRITGPLAQKLTAARKRVREARSTRRAAISEVHEEAKGRLVDASDALKAQQKALYKTYCQDGDLF
WATENDVLDHHKAAVKRIGQMRAAGQPAQLRHHRFDGTGSIAVQLQRQAGQPQRTPELIADVDGKYGRVLSVPWVQ
PDRWERIPRRERRMIGRVTVRMRAGQLSGEPQWLDIPVQQHRMLPLDADITGARLTVTRTAGTLRAQISVTAKIPD
PEPVTDGPDVAVHLGWRNTDTGVRVARWRSTEPIEVPFDFRDTLTVDPGGRSGEIFVPEAVPRRVERAHLIASHRA
DRMNELRARLVDYLAETGPRPHPSREGEELGAGNVRMWKSPNRFAWLARVWADDESVSTDIREALAQWRHQDWISW
HHQEGGRRRSAAQRLDVYRQVAAVLVSQAGRLVLDDTSYADIAQRSATTKTEELPNETAARINRRRAHAAPGELRQ
TLVAAADRDAPVPDTVSHTGVSVVHAKCGHENPSDGRFMSVVVACDGCGEKYDQDESALTHMLTRAVQSAA (SEQ
ID NO: 55)

>WP_061006603.1
[*Mycobacterium mucogenicum*]
MTTMTVHTMGVHYKWQIPEVLRQQLWLAHNLREDLVSLQLAYDDDLKAIWSSYPDVAQAEDTMAAAEADAVALSER
VKQARIEARSKKISTELTQQLRDAKKRLKDARQARRDAIAVVKDDAAERRKARSDQLAADQKALYGQYCRDGDLYW
ASFMTVLDHHKTAVKRIAAQRASGKPATLRHHRFDGSGTIAVQLQRQAGAPPRTPMVLADEAGKYRNVLHIPGWTD
PDVWEQMTRSQCRQSGRVTVRMRCGSTDGQPQWIDLPVQVHRWLPADADITGAELVVRTRVAGIYRAKLCVTARIGD
TEPVTSGPTVALHLGWRSTEEGTAVATWRSDAPLDIPFGLRTVMRVDAAGTSGIIVVPATIERRLTRTENIASSRS
LALDALRDKVVGWLSDNDAPTYRDAPLEAATVKQWKSPQRFASLAHAWKDNGTEISDILWAWFSLDRKQWAQQENG
RRKALGHRDDLYRQIAAVISDQAGHVLVDDTSVAELSARAMERTELPTEVQQKIDRRRDHAAPGGLRASVVAAMTR
DGVPVTIVAAADFTRTHSRCGHVNPADDRYLSNPVRCDGCGAMYDQDRSFVTLMLRAATAPSNP (SEQ ID NO: 56)

>WP_011733919.1
[*Pelobacter propionicus* DSM 2379]
MKRVTITIDGEQTKGIVIGTIAANHTAAEWLLTASVSAKSAKVRFDPEEAVAETSSLVMIAPTRTEKYLYLVPDEQ
VQPVTTIVRKYGLLSPLDWDCPDYPAGDAFEHLFLQNKLWNDLVTIEREHRAKYRELIGSDEETAQMDTEIASIKD
RLSVLDEGRKKLRVEHRKKKCPEIDCLDENIKKLKSELKAVASKAKETRAAAKDRIRAAGNDIENLEKDRQAAVIK
AYNNSGLWWGNYNAVLESYKKARIKALKDGAELKYHRFDGSGRFTNQIQGGMSVQDLLEGNRNVASLRLVSSGELG
DISGKKPPSLDLQSVGSRRDSREYGILAITLYTGTDEQSKKFRRTLSFPVILHRPLPEGATLKSLSVHRKRVGTDF
VWSVVFTFTTDCPTYDQRSSTGNRCGLNLGWKKQAGGGLRVATIYDGSDARHITLPQAIIDGLDYVNGDLQGRIDS
AANENHAWLLEQWGGDELPESLQELRSMLRRSKRPHPAKFAKAVIAWRNYPEYLGDARDEAEQRRKATKRLTIEMA
HKREKLLRRRMDFYRNTAKQLTSVYDVICLDKMDLRRLALLEKGDGTPNELTKIARKQRQQAAISELRECLSKAAA
KNGTQIEQVSTASSATCSACKGKMEQVDGIMWRCRECRALVDQDINAAANLFREVL (SEQ ID NO: 57)

>WP_018234394.1
[*Thioalkalivibrio thiocyanodenitrificans* ARhD 1]
MKRQQEDTEALVYAYGARIPLDDDPHLQEELRKQRAFWDALVEATLAAERELDDRMKADSPQYAAAVQALIDASQAV
REAIERRNAERAKTRSRTTSVDGEVKERITEKNAARKEVWRLAGEWRKANKEAVSEHQARMKEEAKRLRQGCGLYW
GNYNRVLDSFQRARQQTLKKGRRVRPSDPARDDGILAVQIQRTKSGLGASPEELFSGNVSQLQIDRPPPGVEFLPA
NRRRREARVTARMRVDAAGHMIEFPVVLHRPVPPGARIKAAQLVWKREGERWRGQLCLTVSSPKQEREHPGVEACG
IDLGWRLQKDGALRVATVADSKSRLYTYTLPADWMRGMDQVERLSSHLDENAMEVAAWVHAHRDELPEKLTQPAAN
WSPGKGSKWLRDKELHDAVRALNWEVPAEIRHWYERYRHLKTWRDNLRAKLLRSRREVYRLLAADLAGRYAVIGIE
DMDLSKIAKTKKRKDASDPELHATARAQRQRAAVHALRHEIEHQANKHGAQLVHVSGKTTTTCRACGAATGQKDRA
SLIWTCEHCGAVWDQDLNAAGNILDSAMGASAPAATTLAKAKSRRYDLTQPNFRERSKTGSRASARA (SEQ ID
NO: 58)

>33000009441BBAY81_10000005_89
[algae-green algae-macroalgal surface-ecklonia radiata 2]
MPVINWVYRSEEPTNVAAVKNQILLNHRYRNQLIELEHNRRATYKTLAASLCPAYADAVTIYDRAVAELDEAYKDL
RLSRQRARRRHEPTDSQKARINQAKAVRKTAIAQLDAAYKVAKKLIRDAHKVYQDQAAQEITQLADETESQLKRQR
KVRYFELVEEAGLDDGQIAHAREAKIARQQSGVYWGTSRIMEQIAEKTYKKGPPPKFRRWEGSGAIGVRFQGGKPV
AAVMENNSEILHIHIPPGSERLVIGQDRGEVAKGTIRFLVCRDDDGNPVFATFPYVHHRDFPASAKIIDGFAHLKR
VGKKEYWEIRLTIKVDDVVSTVDKSNTCVLHLGHRMIDEQLRCATVMDATQQVSQLFLSSDKLRRFSRPDSLQGIR
ADRFNIIRGEFLDWLASIDVPEWLVERTQTLASHQSPESLYRTVELWRDNRFVMDTETSAQFFTNSLPWAESKLNS
PAVRRKRHPSDIQTVEGIMEFWRSWDRHILQESASINKKAIRNRKHVYRDWLRRLSGRYTHLIVDSTNWATLGKKE
KDDEKVVLVANQRRLARIASPGLLRQCAVEIFGQSNVSVVTSVNMTRTCSTCGQVTEDWDSAKLEYHCSHCTYTVD
QDINAANIMLSRIPDAVPYTEFAEAKRR (SEQ ID NO: 59)

>LSQX01035253_23
[anaerobic digester metagenome]
MITVFKYGVHYRWQVPEVLREQLWLGHQLREDLVTLQLEYEAGLKAIWSSYPDVAAAEESLATAAAEALEAAEEVS
RQRQVQRTKRITGPAADALAAARKRAKEARVVRRSAIAAVKDEAAERISALAAGLRASQKAKYAEYAQGKGLYWAT
FGDVLDHHKTAVKMVAAKRAAGRPAALRHHREDGTGAVAVQLQRPAGKPQRTPALISDPVASNWRNVLHLPWVDPE
QWEQMTRAEQRAQGRVIVRMRCGADIIEVPVQVHRMLPADADITGARLVVAREGSDYRISLTVTARIGDPEPVTAG
PTVALHFGWRGSDAGPVVVRWQSDAPVDIPNDCSAFMVGDRWGGKIVMPSVIVDRLESAAAIQAGRDEQLNTVRAA
VVEWLTVNGPVPHPIRDGEEISSADASRWRRPARFAALAGWWRDAPPAGGEQIAEVLEAWRASDKRLWNTQVHTAG
RALRRRDDLYRQVAAIFADQAGLVVVDDTDMGAVAASRSDAPTAVTDPAARRRTYAAPGVLRASIVAAAAREGVPV
RSVSHKGMSVIHAECGTVNECDDRFLSALIKCEGCGKVYNQDVNALEVVMREGRRHTSVA (SEQ ID NO: 60)

>3300013131|Ga0172373_10056063_2
[aquatic-freshwater]
MGSRVFQFGCPFGPSAGLDETIEQMRLGRAYYNARQEVSRQVRNQTRSIYASCGSVSDLERAVEEAKERKDALELE
IKTARAETRTRWTKKSSAQDLKEARTVLKDARAELGAFRSRLREDPIVAAKLATITGGRPKRKDGEASRRHDNTVK TABLE 2-continued Amino Acid Sequences of Representative CLUST.018837 Effector Proteins*

```
NNGTKALAMRALRAEYGPRGKGLGSGTYLLVEAAQGVSEADTPLYDREGQPQDPGFRCWSMGSKHVAVHVQGFELT
GATIFQPNDWAWIKPVDPRAWLKETPRGERKRLSRTMLHLRLKTGEDREPVWAVVPIIVHREIPLTAKVTWIVLSM
CQQGPRAVWTCEITVNEEAPQSVPEGRGTAAVVEGWRNVSGGILAATWLNTDGVAGQLVLGDGDLDTTDADGGKGG
IISGLTRVDSLKETRDKNLNAALASLVSWLRDHDMPEWMRLRTVKRQYDENHQEVQRVLPSKAQALAYLAGWKAQG
KLAALCLAWRENRFSGDDDAFRALESWRYHDNHLWRWQAAQNESAHLRRRERYRIVGIELAKHARVLLDGTDFARI
AFRPKTEDDKGYVQGPATNRTLVAPSELRDTVKQAAAKMLRDAVKVESANTAITCPRCGMVSKVQRFDDGDFKHSF
CCVECGLTGDQDSIRCMNMLVADGHKDAVLEILRRQEEALRYQRRLSNGGDYGEDASNRSENAGVQGAAREVQCDR
RRGVLLPHDVGG (SEQ ID NO: 61)

>3300013136|Ga0172370_10027535_4
[aquatic-freshwater]
MVTKRLAYGLLEPTENLETVEDQMSKAHKYYNKLVEIENSIRPLRRESYNNGVKRLSPEYEGLEQQLLALQASKDT
IENEIKQQRVLNRSKKLDSSNHKQTLAGIKLQIKLVYEKQKEERAKFKGKLKRPSKEKVEPEPHKRPSKEKVEPEP
HKRPSKEKVEPEPQWLAEQEEIDEKRNKLISEARKASGLYWGTYLSTEDAFKNACKATPPHKNLHFQRWTGEGKIR
VCRNSEPTVSNSLFFIDPLPGDSWEKKKDKGVPSPRGEGKRSRMKTQLHLLVMSNRQKKIAPVWATFPMMLSRPLP
DNGRIDSVEVIRKRCGPNWKWAAQVTCTFEETNKPPKGKAIVALDLGWRKIDGNIRVAAFGAIDDAPISLPSESCP
DLQQAVVKVGNGYELQLTPEVISGIRKSEELRSIRDSEENDIRSILTRWLQENDVPEEIRTLKKRGKLNVMSQLQF
IHWINSLRSQAQLASLIYRWKDNRFEGYEEILEALENWRYADQHLWEWESEQRRGAIARRNNLEKNFASWLRSIAT
MVVIEGDFKITDVAERKGLIEDTNRNEIAQSNRQLAGTSILRICIKNKLGNDCIGVPAKNTSKECHVCGEVVEFAD
PAALEQECHNHHQWDRDHNAWKVLLKRYASGDVIVKTLGTARKGKKKRNSKKLATGEQKIVG (SEQ ID NO: 62)

>3300013137|Ga0172375_10012175_6
[aquatic-freshwater]
MGSRVFQFGCPFGPSAGLDETIEQMRLGRAYYNARQEVSRQVRNQTRSIYASCGSVSDLERAVEEAKERKDALELE
IKTARAETRTRWTKKSSAQDLKEARTVLKDARAELGAFRSRLREDPIVAAKLATITGGRPKRKDGEASRRHDNTVK
NNGTKALAMRALRAEYGPRGKGLGSGTYLLVEAAQGVSEADTPLYDREGQPQDPGFRCWSMGSKHVAVHVQGFELT
GATIFQPNDWAWIKPVDPRAWLKETPRGERKRLSRTMLHLRLKTGEDREPVWAVVPIIVHREIPLTAKVTWIVLSM
CQQGPRAVWTCEITVNEEAPQSVPEGRGTAAVVEGWRNVSGGILAATWLNTDGVAGQLVLGDGDLDTTDADGGKGG
IISGLTRVDSLKETRDKNLNAALASLVSWLRDHDMPEWMRLRTVKRQYDENHQEVQRVLPSKAQALAYLAGWKAQG
KLAALCLAWRENRFSGDDDAFRALESWRYHDNHLWRWQAAQNESAHLRRRERYRIVGIELAKHARVLLDGTDFARI
AFRPKTEDDKGYVQGPATNRTLVAPSELRDTVKQAAAKMLRDAVKVESANTAITCPRCGMVSKVQRFDDGDFKHSF
CCVECGLTGDQDSIRCMNMLVADGHKDAVLEILRRQEEALRYQPAAE (SEQ ID NO: 63)

>3300010293|Ga0116204_1010874_1
[aquatic-freshwater-anoxic lake water]
MLDQLRLASVYRNKLVEIELARRAATDDTLRELCPGLLECEAELADVNAKIAEAIAEHKAKNAKARCLTDDKEIKA
ALTQLKCIRKELATTRKRLRDDGESPLTEADLSLVPGLAEATKIHAAAENPHAKAKAAVMHECRSSWLNDPSRPT
PIRRLAIQIQLAEIGYAANEAQKTARKTSGLAPGSYLLVDQAADAFRKGAPPVERGYQGEGRVGVQIVGGMNSEEA
NSGRDTRLRIVHTPQAEQRVAKNGRVLPAPGAKRQAQQYTLWLRIGSDGRTPTWATWPLILHRPIPETTRIMWAIV
QRRIVGGHERWQLTLNLRDDTNAAFARRDVTASGVCGVDIGYRYIDDRAQRVAYWHGSDGASGELQLPSGKVAQWK
KVDDLQSIRDGLHNEARAALRDWLATNAHPEWLDEATEHMMHAWRRLSRLDRLVAQWRGQRFDGDAEIMATLESWRT
RERHLWQYQEQMRDQLLAWRKDFYRNFAAMLRRRYRTIAVEDMDLRSAIHDVLRPEEERETVTAQRRAARFAALSV
LVAAIKDSGADVVAVEQAGTTSTCSWCGASNEVGTGVIHTCVGCGREWDRDDNAARNICARGEVAVKTR (SEQ
ID NO: 64)

>3300010293|Ga0116204_1010874_2
[aquatic-freshwater-anoxic lake water]
MSSKNYTYGLQTPVGNRDRVLDQLRLASVYRNKLVEIELARRAATDDTLRELCPGLLECEAELADVNAKIAEAIAE
HKAKNAKARCLTDDKEIKAALTQLKCIRKELATTRKRLRDDGESPLTEADLSLVPGLAEATKIHAAAENPHAKAKA
AAVMHECRSSWLNDPSRPTPIRRLAIQIQLAEIGYAANEAQKTARKTSGLAPGSYLLVDQAADAFRKGAPPVERGY
QGEGRVGVQIVGGMNSEEANSGRDTRLRIVHTPQAEQRVAKNGRVLPAPGAKRQAQQYTLWLRIGSDGRTPTWATW
PLILHRPIPETTRIMWAIVQRRIVGGHERWQLTLNLRDDTNAAFARRDVTASGVCGVDIGYRYIDDRAQRVAYWHG
SDGASGELQLPSGKVAQWKKVDDLQSIRDGLHNEARAALRDWLATNAHPEWLDEATEHMMHAWRRLSRLDRLVAQWR
GQRFDGDAEIMATLESWRTRERHLWQYQEQMRDQLLAWRKDFYRNFAAMLRRRYRTIAVEDMDLRSAIHDVLRPEE
ERETVTAQRRAARFAALSVLVAAIKDSGADVVAVEQAGTTSTCSWCGASNEVGTGVIHTCVGCGREWDRDDNAARN
ICARGEVAVKTR (SEQ ID NO: 65)

>3300008255|Ga0100403_1011992_3
[aquatic-freshwater-aquifer]
MTRVFEYGLPFDPPFDGAELVDEQILLAHRYYNKLIELEHTRRSSILAVQRADPKVGPLLAAYDAANAEVEDLLARK
REAKSRDRRVAAPELSEIEAAKEARRHLSVQLRKVKKVATDRLKVPKAAPATRDAKAAAKKAARAASGVFWGTYSLIE
QAADAAAKAKPVLRPGTHPRPWDQQPSFRRWTGEGMVAVQININRPLNDVTVFGDDLRLRITPVDPAAWSDATSRG
DRKCLARTNVTMRVGRNTGETATWPMVMHRPLPAGSRVTWAKVLRWRLDDRPHWFKYVLQLTVETADAPRHPGLVS
LPPAIVAINCGWRALPNGSLRVVTWVGSDGAEGVLDLGCREYRDRIERAESIRSVRDQLRNELTSKLVGIGIDVTR
WRSFDREHRLFRELTAEGCERNEAVELLEAWHHRDRHLRQYQDGARGGALRFRREQYRLLAVELARRYPVVCVESW
DLRPVVTDEDRLPGPAAARVEGASSTARLALASAATREGCVVLTQIAAHVRLQTQTCHVCGYGAKKGEEWDAAAEL
VHTCEGCGETWNQDVNFCRNILAASRAAVTEIPELLVPKIMKRSARFAARHKKVAT (SEQ ID NO: 66)

>3300014155|Ga0181524_10003409_23
[aquatic-freshwater-bog]
MLVYKWGIGPLPLEARQIIDREVRAAHRYRNRLVEIERSRRAAYRDLRNSLSPELAHLHAAYAAADRAVVEGRRLL
SGVPRAERARHPVAAEVRRLSAARSGAWKAYAEARDRTTADVFGAADQKYREAKQSVTAAVGFACAVARFARGADP
GPIGPHVLAAITAAVRERALADPAVGEPWKAKTRSQMEHEALAKRARAECGCAVGTYLAVEAAAEKSFAECAGDPP
FSRLECERVGLQVRGGGLSADDVVGAAVGQVRVEFPADMTARANGTRYAVVHLSGRGDQATWLHLPVVWHRDMA
PEARVRWAYVVARRVGLVWHYELQLTCDSVDRARAQSAGARGTIALNLGWRALKNGDLRVATPWSGSASRAEDRLV
LPRSFREGSDLADRLLSYADEHFLAVRDALAGWFKGGERSLFSPEQVAAWSLDTVHAWRSHGRLARVALDLRRDWL
EARGVDVPALWKAWRLERSPKLDLFGPLDEIKAWLAGRGVVSADQVLAVYLDWWRAKDRHLVNWARNNDLRLRRSR
```

TABLE 2-continued

Amino Acid Sequences of Representative CLUST.018837 Effector Proteins*

RDRYRCYARDLAARYERVVIEQWNKSETAETPDPEADTRTEQEVRGNSNRVLACVSELVDALEAAFGEANVHRAPS
ERITVEHHGCGGESSDPLPQIPVTCFACGQVYDQDLNAAKHLYDRHSGEPSGGVNVGGGARGAKKSRRVEGFGRAA
E (SEQ ID NO: 67)

>3300014156|Ga0181518_10000096_28
[aquatic-freshwater-bog]
MLVYKWGIGPLPLEARQIIDREVRAAHRYRNRLVEIERSRRAAYRDLRNSLSPELAHLHAAYAAADRAVVEGRRLL
SGVPRAERARHPVAAEVRRLSAARSGAWKAYAEARDRTTADVFGAADQKYREAKQSVTAAVGFACAVARFARGADP
GPIGPHVLAAITAAVRERALADPAVGEPWKAKTRSQMEHEALAKRARAECGCAVGTYLAVEAAAEKSFAECAGDPP
FSRLECERVGLQVRGGGLSADDVVGAAVGQVRVEFPADMTARANGTRYAVVHLHLSGRGDQATWLHLPVVWHRDMA
PEARVRWAYVVARRVGLVWHYELQLTCDSVDRARAQSAGARGTIALNLGWRALKNGDLRVATPWSGSASRAEDRLV
LPRSFREGSDLADRLLSYADEHFLAVRDALAGWFKGGERSLFSPEQVAAWSLDTVHAWRSHGRLARVALDLRRDWL
EARGVDVPALWKAWRLERSPKLDLFGPLDEIKAWLAGRGVVSADQVLAVYLDWWRAKDRHLVNWARNNDLRLRRSR
RDRYRCYARDLAARYERVVIEQWNKSETAETPDPEADTRTEQEVRGNSNRVLACVSELVDALEAAFGEANVHRAPS
ERITVEHHGCGGESSDPLPQIPVTCFACGQVYDQDLNAAKHLYDRHSGEPSGGVNVGGGARGAKKSRRVEGFGRAA
E (SEQ ID NO: 67)

>3300014158|Ga0181521_10000063_92
[aquatic-freshwater-bog]
MLVYKWGIGPLPLEARQIIDREVRAAHRYRNRLVEIERSRRAAYRDLRNSLSPELAHLHAAYAAADRAVVEGRRLL
SGVPRAERARHPVAAEVRRLSAARSGAWKAYAEARDRTTADVFGAADQKYREAKQSVTAAVGFACAVARFARGADP
GPIGPHVLAAITAAVRERALADPAVGEPWKAKTRSQMEHEALAKRARAECGCAVGTYLAVEAAAEKSFAECAGDPP
FSRLECERVGLQVRGGGLSADDVVGAAVGQVRVEFPADMTARANGTRYAVVHLHLSGRGDQATWLHLPVVWHRDMA
PEARVRWAYVVARRVGLVWHYELQLTCDSVDRARAQSAGARGTIALNLGWRALKNGDLRVATPWSGSASRAEDRLV
LPRSFREGSDLADRLLSYADEHFLAVRDALAGWFKGGERSLFSPEQVAAWSLDTVHAWRSHGRLARVALDLRRDWL
EARGVDVPALWKAWRLERSPKLDLFGPLDEIKAWLAGRGVVSADQVLAVYLDWWRAKDRHLVNWARNNDLRLRRSR
RDRYRCYARDLAARYERVVIEQWNKSETAETPDPEADTRTEQEVRGNSNRVLACVSELVDALEAAFGEANVHRAPS
ERITVEHHGCGGESSDPLPQIPVTCFACGQVYDQDLNAAKHLYDRHSGEPSGGVNVGGGARGAKKSRRVEGFGRAA
E (SEQ ID NO: 67)

>3300014159|Ga0181530_10000119_98
[aquatic-freshwater-bog]
MLVYKWGIGPLPLEARQIIDREVRAAHRYRNRLVEIERSRRAAYRDLRNSLSPELAHLHAAYAAADRAVVEGRRLL
SGVPRAERARHPVAAEVRRLSAARSGAWKAYAEARDRTTADVFGAADQKYREAKQSVTAAVGFACAVARFARGADP
GPIGPHVLAAITAAVRERALADPAVGEPWKAKTRSQMEHEALAKRARAECGCAVGTYLAVEAAAEKSFAECAGDPP
FSRLECERVGLQVRGGGLSADDVVGAAVGQVRVEFPADMTARANGTRYAVVHLHLSGRGDQATWLHLPVVWHRDMA
PEARVRWAYVVARRVGLVWHYELQLTCDSVDRARAQSAGARGTIALNLGWRALKNGDLRVATPWSGSASRAEDRLV
LPRSFREGSDLADRLLSYADEHFLAVRDALAGWFKGGERSLFSPEQVAAWSLDTVHAWRSHGRLARVALDLRRDWL
EARGVDVPALWKAWRLERSPKLDLFGPLDEIKAWLAGRGVVSADQVLAVYLDWWRAKDRHLVNWARNNDLRLRRSR
RDRYRCYARDLAARYERVVIEQWNKSETAETPDPEADTRTEQEVRGNSNRVLACVSELVDALEAAFGEANVHRAPS
ERITVEHHGCGGESSDPLPQIPVTCFACGQVYDQDLNAAKHLYDRHSGEPSGGVNVGGGARGAKKSRRVEGFGRAA
E (SEQ ID NO: 67)

>3300014201|Ga0181537_10003972_13
[aquatic-freshwater-bog]
MSENMPTLVYRYGIAAPHDNADLVYEQLRLAHEYRCSLVRIERTRRAEERAARLAVSAEVAAAEAAVAAADAECER
LATEIRKARSDARKRVETQQMRDALAKAREVRKERKTALFELRDRYQPQCRDCRATKSEDKPCPHVGQEAQSFCLV
LDAIAERAKESIRKARAESGLYWGSYLLVDRAMAASRKAPLYGDDGITPNDPKMPREDGGGAVAIQFQSSSVRPSN
VRLADLGPDNARLQIVLPPWPEQCMPAPESHQGPFDPSRPPAGMRPDGTLAPATRADGSPARWLRRRANRQALVRM
CVKTEGRGKPVWAAWRLDYDRPLPAQAIISWATIHRRMRGPHAEWSLCLTVEVAAEPAAEIRSGQVAIDVGWRQMP
CPGGAACHGQRTDCHELRVAAWRDHGGGSGELRLSARDIRALRQPAELRSKRDTQFDAIKAAVAGWIRSASDAPEW
MREAAKVMHAWRWQGRMVALVRQWAQERPNRAAPEEAVYQAALAWQTADWALWESERARDAWAHRRRREIYRVWAA
RMAETYGTLILERFDLRDVTERAPVGQDDSENETARSNRHLAAVSELRGALCNAVRTRGSEVVGVTAVNSTRTCPS
CGLVSDRNQAQAVQLACECGHVWDQDVEGAAPWLLAEYRERPGDAKLQAGARAEAIAAARKGKKGNDWARAKRMGA
AKKGRLQAARESAATEAQ (SEQ ID NO: 68)

>3300014201|Ga0181537_10021284_1
[aquatic-freshwater-bog]
MKLVYKYGLATPHDNRELVEEQMRAAHRYRNTLTEIERGRRAAVRQAEAEAGDMPKALQALRASEAELEAALTAIR
RHRARTSKRDEPVALKASAKAAREAKRAASKAFRDLRRRIAEDPMVVAAKDAIGERANELGRSARAHSGVYWGSYL
LVEAAASASFEDTPMYASDGRPTDPAFVRWTGEGEVGVQLQGGLGADEATACTDTQLQITQPDERAWERRGRTHRE
CEQMARQAQLRMRVQSDAKGKPVWATWRMDMHRPLPEGAIIKLATVHRVRVGPHSKWYVTITLDVPARARVSPSSG
TVAVDVGWRVVGDELRVAGWQDTTGARGELRLSPRDIAMLRAPEAMRSERDRRFDAARANLLGWLRSHQELVPEWL
AKATTTLHAWRSEARLVALYSRWSGSRFEGDEQPYYALASWRARARHEWAVESCARDQALRRRRERYRVWAAQLAS
KYNTIVIEKFDKREVAVIPAPDVQVEQNAEQAARDKAARSNRFLAATSELCDCLVTAARSRGCTVIAVPCEDTTRT
CPVCGLVESRDAAAAIELTCECGASWDQDVDGAPAVLLARARERPGDTKILVGAREDEKKNENGQKPESQWQRVRR
MRAEKEARMGTAREAAPEGAE (SEQ ID NO: 69)

>3300014201|Ga0181537_10040512_3
[aquatic-freshwater-bog]
MTTRVYQFALLPPSGRDAALVDAQMRLAWEARQDMAMIERGRRSAMRALLDTPDVRAAEEALKAATRSTRKDVIRV
VSRARRDALERAVASERYDDEACQETGYCPLYEPERIEQLAKLATKGAYHYFGDRGLAWGTRLDVSGAADAARKAP
LYDDDGLTPSDPHVERWYDAKRPPDSQLAVQLQGGLSTPDGLTGQDTRVRLVDGVLWLRVGSDGRAPVWAKFAIAR
PHRTGKRGVRTTHRAIPDDAKWKWVRVSRRRDGPWMRWSVEITLDVEREDWRVRDPQVQGVLAVEVCWDRPDDAIV
VARWRDDSGRSGTIELPDRIATGLPKVHGIRAVRDTIRADMAKRLQRALTEDRDPKPVWLADAAGSMHLWKSSSRF
HRLIQQWQDERCDAARPAYELLDAWRLRDNHLYEYETGARGNVLRWRKNWYQTLAAEWARRYRIVVLDDRNLSREA
RWGEASEIRFMASPFELRQAIRNAFGRDVAEHTVKQTEKEKDEDDRDWCERALDARNAGVARTERETSEIKDKRGG
AWAKRKQAKTTRHAEREAARKAVVKAAE (SEQ ID NO: 70)

TABLE 2-continued

Amino Acid Sequences of Representative CLUST.018837 Effector Proteins*

>3300014654|Ga0181525_10000532_4
[aquatic-freshwater-bog]
MAVYVYQFGLSAPFGENADLVYDQLFATHRYRNTLIEIERGRRAAVRAVIDASNAQTVALTAEVARWNAETEALAK
RIKSQRASTRTRSESESDREALRQAREARKAAVTKLREARLAQRTDAAMTAAIDAINERANGLVRGARELTETYWG
TYLLTEKAMQDSKALPLYGDDGISPNDPKFLRWEGDGALGVQIQGGAKAATILAEASTLLRMRPDARAYLERACDQ
RRIKDKTGLLTMRVGSDAKGGPIWATWHMHMHRLIPENAMIKGATVHLRKVGTKAEWSLEVTVEHSRAALPPNDKT
IAIDIGWRMIGDELRVAGWMDSDGKTGELRLSAKDIRLLRRPEEIRGERDRHFTLAKTALGSFLASAAQVPDRLRA
ETAHLDRWGSADRLAAVVARWERFEGDAAIHNVMTAWFWRDRNLCDQEAGMRLQALRRRKNKYREWAAWVTETYGT
VVVEKFDLRAVALRGAVEDPAANETARSNRQLAALSEARTAIVNAASSRGRLIAAMPAHDTTRACPSCGVVEAREA
EASIVLVCPDCGATWDQDVTGAPVVLLGRWRERPGDAKILVSARDGANDNESETMRPNRWQKVKEARTAKVLRRES
ARAEASNGAE (SEQ ID NO: 71)

>3300014657|Ga0181522_10000394_52
[aquatic-freshwater-bog]
MKELRGNHELRNRLVEIERERRKAVRALCADLPELAAAQVCRTALDEALQTIKKARSETKKRSESAEDVKRAKEAR
KAYQEALRALALARRARLSACEAEIKVVNDESAKREKEAYGESPVEAWGSKLDVFAAHAAVRAMPYWDELADNDPH
FVRWEGEGQIAVQLQGGLRVGAALSGGDRREQLTDLVPEAFEATDAAKNPRDRRRLRGAVGRLRIGSDARNPIWTE
VRVQVHRPLPPSGIIKWARLSRRRVALAYAWSLEVTVDVPLSAVARPGVVGLDLGWRKKPDGSLRVGYLAFRETAK
DAIATRTRELVLPASLVQRFARLREAESERTHAFEMERMWLSRLLSTFVELPDWLKKESETLSQWRSPARLARLAR
IWSENRFERDELPYERLRGWAAGDALRYQENEEARQSALRAREWYYGNWAAACANAYGALAVENMNISRLIRHRDP
DADEPAHEERARSRAVAAPGRLRQVFAHAFEGRGGIVMLRPTKNTTITCPTCGDVRKFDAAEILAPTCANGHTIDQ
DERAARNLCEGVSGEEAAEAARAREVRESTPKESRWAKVKRMKREKEEGALARGVGSAG (SEQ ID NO: 72)

>3300014657|Ga0181522_10000394_53
[aquatic-freshwater-bog]
MNRVYRYSCSPPKTEAERVMKELRGNHELRNRLVEIERERRKAVRALCADLPELAAAQVCRTALDEALQTIKKARS
ETKKRSESAEDVKRAKEARKAYQEALRALALARRARLSACEAEIKVVNDESAKREKEAYGESPVEAWGSKLDVFAA
HAAVRAMPYWDELADNDPHEVRWEGEGQIAVQLQGGLRVGAALSGGDRREQLTDLVPEAFEATDAAKNPRDRRRLR
GAVGRLRIGSDARNPIWTEVRVQVHRPLPPSGIIKWARLSRRRVALAYAWSLEVTVDVPLSAVARPGVVGLDLGWR
KKPDGSLRVGYLAFRETAKDAIATRTRELVLPASLVQRFARLREAESERTHAFEMERMWLSRLLSTFVELPDWLKK
ESETLSQWRSPARLARLARIWSENRFERDELPYERLRGWAAGDALRYQENEEARQSALRAREWYYGNWAAACANAY
GALAVENMNISRLIRHRDPDADEPAHEERARSRAVAAPGRLRQVFAHAFEGRGGIVMLRPTKNTTITCPTCGDVRK
FDAAEILAPTCANGHTIDQDERAARNLCEGVSGEEAAEAARAREVRESTPKESRWAKVKRMKREKEEGALARGVGS
AG (SEQ ID NO: 73)

>3300009175|Ga0073936_10014029_2
[aquatic-freshwater-freshwater lake hypolimnion]
MNPASMAPKGMIVGLLMTYNIYLPLLECKFEACRIYLGVLAIGQARYTSEKLEAKKMLDKGAKVTFTYDGNETSGK
ILHILAAGKKPAAYFDILTAADKALEADRCEDETRSCEDESYLVVTKRSKNTVAKIYWLSKDDLSGVQVVVRQYGL
LQPSNWQDDCFNHLYLQNRYWNCLVEIEQDNRNKYRALVGEDDPIQDAIDGLKSRIADMAEQRTQLKIEHCKK
IGIHTEPLDNAIKAAKAEMKKLSNKAKEARAVAKERIRAAGPAFKLLEDERRQSVKEAYNNSQLWWGNYNAITNSY
NTARTRAMKEGADLREHREDGSGRFTCQIMGGMSTDDLLSGRNSVAQLRKVSNSEFTKIIKSNPPALQLQLVGSRR
DEREYGVLSITIYTAEDDQGKKTRRTLDEPIILHRPLPENATLKIISVNRKKIGTDYRWAVTFTESEETKESIVHT
SKQTCGINLGWKQVAGGLRVATVSDGTSTRHVVLPQVIIDKLAYTESLQSRIDTATNENFIWLLGKMADPPEILKG
DVTSLKRSKRPHPAKFAKEVIKWRNECSEFEPQALIEAEVMRKNVKRLSLEHHHLRDKVLRRRIDFYRNEAKKIAD
KYSMIVMDKMDLRQMSALEKSDGTPNELADLARYHRKVAAISEFREWIGKQAIKAGGAVEMIAIESTRTCNACDGV
MAPSDGLMFRCKSCGTFVDQDENASANLLRAVT (SEQ ID NO: 74)

>3300015360|Ga0163144_10020017_5
[aquatic-freshwater-freshwater microbial mat]
MSVRVYKYGLRRPHEQGERVRAQMRAAHRYRNTLVEIERARRTAVRSAMSAYGNIGELEAAARSADVVVSDAVRLA
KAAKAEARSHSGVSSDQKAALLAARERKRDAVRLLRETRVLLRQDVVLSTEVDRVNELAAELRRNARKHCGVYWGT
YLLIEAADEAARKVPLYDGAEPSDPRFMRWAGEGRVGVSIAKGADIAVLDDTKDTRIRIEPGTMPKGADPASKRSA
KRRHAVLAMRVGSGDQREPVFARWEMVMHRSLPAGARIKNAAVSLRLVGPREEWSVAITLDTTACAETATRGRGVV
GVDLGWRMLNGDIRSAAWDGGDVSGFLALPAELIGQVEKVADLRSIRSKNFDASRAALVAAMPADAPAWLRGATAS
LGQWKSIDRLTKLALRWRVAREDGDAAAYDALEAWRYNDHHLWCWESEQRTRTLRHRREIYRIFAAKLAREYETLA
IENFDLRVESVRAPVETDASIDTVTRAARVVVSPSELRLSLVNAFGPHRVVKVDAANTTRECSECHHINTWDAAAE
LSHTCAQCGARWDQDANAARVIRARGTAASPAPGAARNGDSANDSAAPIESRWAKAKRMRAEKRSGEGGARKPVDA
AAE (SEQ ID NO: 75)

>3300015360|Ga0163144_10020017_4
[aquatic-freshwater-freshwater microbial mat]
MRAAHRYRNTLVEIERARRTAVRSAMSAYGNIGELEAAARSADVVVSDAVRLAKAAKAEARSHSGVSSDQKAALLA
ARERKRDAVRLLRETRVLLRQDVVLSTEVDRVNELAAELRRNARKHCGVYWGTYLLIEAADEAARKVPLYDGAEPS
DPRFMRWAGEGRVGVSIAKGADIAVLDDTKDTRIRIEPGTMPKGADPASKRSAKRRHAVLAMRVGSGDQREPVFAR
WEMVMHRSLPAGARIKNAAVSLRLVGPREEWSVAITLDTTACAETATRGRGVVGVDLGWRMLNGDIRSAAWDGGDV
SGFLALPAELIGQVEKVADLRSIRSKNFDASRAALVAAMPADAPAWLRGATASLGQWKSIDRLTKLALRWRVARFD
GDAAAYDALEAWRYNDHHLWCWESEQRTRTLRHRREIYRIFAAKLAREYETLAIENFDLRVFSVRAPVETDASIDT
VTRAARVVVSPSELRLSLVNAFGPHRVVKVDAANTTRECSECHHINTWDAAAELSHTCAQCGARWDQDANAARVIR
ARGTAASPAPGAARNGDSANDSAAPIESRWAKAKRMRAEKRSGEGGARKPVDAAAE (SEQ ID NO: 76)

>3300015360|Ga0163144_10033243_8
[aquatic-freshwater-freshwater microbial mat]
MSIRVYKYGLRRPHEQSERVRAQMLAAHRYRNTLVEIERARRAAVRSAMSAYGNIGELEAAAHAADTVVLGVVRLA
KAAKAEARSHSGISSDQKAALSAARGEHRRDAVRLLRETRVLLRQDVVLSTEVDRVSELACELRKSARKHCGVYWGT
YLLIEAADEAARKAPLYDGAEPSDPRFARWIGEGRVGVSIMKGADISVLDMEDTRIRIEPGTMPKGADPTSKRSAK
RRHTVLAMRVGSDDQRGPIFARWEMVMHRPLPAGARIKNAAVSLRLVGPREEWSVAITLDTTACAETATSGRGVVG
VDLGWRMLDGDIRSAAWDGGDLSGYLALPAELIGQVEKVADLRSIRSKSFDASRDALIAVMPTNAPAWLRAATSSL TABLE 2-continued Amino Acid Sequences of Representative CLUST.018837 Effector Proteins*

RQWKSINRLTKLALRWRVAREDGDAAAYDALEAWRYNDHHLWCWESEQRTRTLRHRRETYRIFAAKLARKYETLAI
ENFDLRVESVRAPVETDASIDTITRAVRVVVSPSELRRSLINAFGPHRVVKVDAANTTRECAECHHINTWDAAAEL
SHTCAQCSARWDQDANAARITRARGAAASPQGRNSDSATTTESRWAKAKRMRAEKRSGEGGDRKSVDTAAE (SEQ
ID NO: 77)

>3300015360|Ga0163144_10033243_7
[aquatic-freshwater-freshwater microbial mat]
MSAYGNIGELEAAAHAADTVVLGVVRLAKAAKAEARSHSGISSDQKAALSAAREHRRDAVRLLRETRVLLRQDVVL
STEVDRVSELACELRKSARKHCGVYWGTYLLIEAADEAARKAPLYDGAEPSDPRFARWIGEGRVGVSIMKGADISV
LDMEDTRIRIEPGTMPKGADPTSKRSAKRRHTVLAMRVGSDDQRGPIFARWEMVMHRPLPAGARIKNAAVSLRLVG
PREEWSVAITLDTTACAETATSGRGVVGVDLGWRMLDGDIRSAAWDGGDLSGYLALPAELIGQVEKVADLRSIRSK
SFDASRDALIAVMPTNAPAWLRAATSSLRQWKSINRLTKLALRWRVAREDGDAAAYDALEAWRYNDHHLWCWESEQ
RTRTLRHRRETYRIFAAKLARKYETLAIENFDLRVESVRAPVETDASIDTITRAVRVVVSPSELRRSLINAFGPHR
VVKVDAANTTRECAECHHINTWDAAAELSHTCAQCSARWDQDANAARITRARGAAASPQGRNSDSATTTESRWAKA
KRMRAEKRSGEGGDRKSVDTAAE (SEQ ID NO: 78)

>3300015360|Ga0163144_10062707_6
[aquatic-freshwater-freshwater microbial mat]
MSSRSKENRMFGHESKPTRNYVYGILAPTEGADLVDEQLRAAHQYRNNLVRLELDRREAVQQCLLAMRPAVARLTG
EVADAVTAYDAAAAALKVRNARERNKRASADERQASKDAAALLKGLRGQLKAVRTEAFAADDVRAALDAIETVASE
RRREARGACGVYWGTYLTVEQAAGSFRSGAPPIEHRWTGEGRLATQLQNGVEPAVLTLGQDKRLRIELTGECGRGK
RPLAVAWLRVGSDGRAPVWAKFPMVYHRPIPVDAKIKWAFVHRRRCGTEWRWQLMLSVARDAWESPTTSGGSVGID
LGWRVVPEGLRVASWAGDDGRRGELILPADDLRRWSEPATRRAERDVREGEFLPRVADWFAANAGRPGEEMRERVK
TIRQWRSPARLAGLLRAWSAERVTGDEETYGELVRWMREDSREWNSESGQRARASRWRDDYYRCFVKRLASEYRVV
HVEDMDLREIKRKPKAEEEAESENQTARGNAFIASPGRLRELIREGFAETMSIDAAWTTQRCHACGEIDGFDAAAEL
VRTCRHCGVAEDQDYRAAMNLLHGEQPDADEMAVVARGV (SEQ ID NO: 79)

>3300015360|Ga0163144_10062707_6
[aquatic-freshwater-freshwater microbial mat]
MFGHESKPTRNYVYGILAPTEGADLVDEQLRAAHQYRNNLVRLELDRREAVQQCLLAMRPAVARLTGEVADAVTAY
DAAAAALKVRNARERNKRASADERQASKDAAALLKGLRGQLKAVRTEAFAADDVRAALDAIETVASERRREARGAC
GVYWGTYLTVEQAAGSFRSGAPPIEHRWTGEGRLATQLQNGVEPAVLTLGQDKRLRIELTGECGRGKRPLAVAWLR
VGSDGRAPVWAKFPMVYHRPIPVDAKIKWAFVHRRRCGTEWRWQLMLSVARDAWESPTTSGGSVGIDLGWRVVPEG
LRVASWAGDDGRRGELILPADDLRRWSEPATRRAERDVREGEFLPRVADWFAANAGRFGEEMRERVKTIRQWRSPA
RLAGLLRAWSAERVTGDEETYGELVRWMREDSREWNSESGQRARASRWRDDYYRCFVKRLASEYRVVHVEDMDLRE
IKRKPKAEEEAESENQTARGNAFIASPGRLRELIREGFAETMSIDAAWTTQRCHACGEIDGFDAAAELVRTCRHCGV
AEDQDYRAAMNLLHGEQPDADEMAVVARGV (SEQ ID NO: 80)

>3300020057|Ga0163151_10006104_16
[aquatic-freshwater-freshwater microbial mat]
MSVRVYKYGLRRPHEQGERVRAQMRAAHRYRNTLVEIERARRTAVRSAMSAYGNIGELEAAARSADVVVSDAVRLA
KAAKAEARSHSGVSSDQKAALLAARERKRDAVRLLRETRVLLRQDVVLSTEVDRVNELAAELRRNARKHCGVYWGT
YLLIEAADEAARKVPLYDGAEPSDPRFMRWAGEGRVGVSIAKGADIAVLDDTKDTRIRIEPGTMPKGADPASKRSA
KRRHAVLAMRVGSGDQREPVFARWEMVMHRSLPAGARIKNAAVSLRLVGPREEWSVAITLDTTACAETATRGRGVV
GVDLGWRMLNGDIRSAAWDGGDVSGFLALPAELIGQVEKVADLRSIRSKNFDASRAALVAAMPADAPAWLRGATAS
LGQWKSIDRLTKLALRWRVARFDGDAAAYDALEAWRYNDHHLWCWESEQRTRTLRHRREIYRIFAAKLAREYETLA
IENFDLRVFSVRAPVETDASIDTVTRAARVVVSPSELRLSLVNAFGPHRVVKVDAANTTRECSECHHINTWDAAAE
LSHTCAQCGARWDQDANAARVIRARGTAASPAPGAARNGDSANDSAAPIESRWAKAKRMRAEKRSGEGGARKPVDA
AAE (SEQ ID NO: 75)

>3300020186|Ga0163153_10017638_7
[aquatic-freshwater-freshwater microbial mat]
MTSVYRYGLLPPTLGADVVDDQMRAGHRYQNALVELERARRDAVAGVLSNNAIDEIDLEIKALDEELSARRAAIQA
ERGATKRKRVPHTTATRDIARRRELRGTRRTLIAARRADPAVMAALAGIEERAKVLHKQFRADSGVYWCTYLKVEQ
AMDAARKGAKFGPPSFRRWNGGGAVSMQLQRRGPERLLMTADNAIECDDPRLHLDLIPTPVPNRRGKPLPRVRLRV
GSDGARRPIWAEWPMIYHRPLPDGAVITWATVIRELVASSPRWALLLTIEHGGVAPTAARGAAVAVDLGWRRAIVD
GDITTRACGHTATDDSDESELHVHRDVFGALGKADNLRSIRDKRMNEMQAILVAWLRGCGSEEHRERTREVAQWRA
CARFAGLAIWWRDHRIEGDELIFVLLEAWRKDKHLWLWEAHARRTARARRLDGYRVFAADLARRYETLIVEKINL
AKVAEKPKPESTREHNATASSQRTATAPSELRGALVNAFRGRGGTVVEVGAHPSATAMLGEWRERPVAEEKPGVAR
MSKFGRLRAERGGSWAQRSRPLEGGSASD (SEQ ID NO: 81)

>3300020195|Ga0163150_10003396_14
[aquatic-freshwater-freshwater microbial mat]
MTSVYRYGLLPPTLGADVVDDQMRAGHRYQNALVELERARRDAVAWVLSDGVIDEIDRGIEALSEELSAQRAGIQA
ERGATKRKRVPHTAETRGLDDRRRELRGTRRTLIAARRADPAVMAALAGIEERAKVLSKLLSKSSGVHWGTKGVVH
QAMDAARKGAKFGPPSFRRWNGGGAVSMQLQRTGREKRPLTADDAIECDDTRLHLDLTPTPVPNRRGKPRRGKPLP
RVRLRVGSDGARRPIWAEWPMIYHRPLPDGAVITWATVIRELVASSPRWALLLTIEHGGVAPTAARGAAVAVDLGW
RRAIVDGDITTRACGHTATDDSDESELHVHRDVFGALGKADNLRSIRDKRMNEMQAILVAWLRGCGSEEHRERTRF
VAQWRACARFAGLAIWWRDHRMEGDELIFVLLEAWRKRDKHLWLWEAHARRTARARRLDGYRVFAADLARRYETLI
VEKINLAKVAEKPKPESTREHNATASWQRTATAPSELRGALVNAFRGRGGTVVEVGAHPSATAMLGEWRERPVAEE
KPGVARMSKFGRLRAERGGSWAQRSRPPEPLEGGSASD (SEQ ID NO: 82)

>3300020203|Ga0163148_10001247_2
[aquatic-freshwater-freshwater microbial mat]
MFGHESKPTRNYVYGILAPTEGADLVDEQLRAAHQYRNNLVRLELDRREAVQQCLLAMRPAVARLTGEVADAVTAY
DAAAAALKVRNARERNKRASADERQASKDAADLLKGLRGQLKAVRTEAFAADDVRAALDAIETVERERRREARGAS
DVYWGTYLTVEQAAWSERSGAPPIEHRWTGEGRLAIQLQNGVEPAVLTLGQDKRLRIELTGEYGRGKRGKRPLAVA
WERVGSDGHTPVWAKFPMVYHRPIPVDAKIKWAFVHRRRCGTEWRWQLMLSVARDAWESPITSGGSVGIDLGWRVV TABLE 2-continued Amino Acid Sequences of Representative CLUST.018837 Effector Proteins*

PEGLRVASWAGDDGRRGELILPADDLRRWSEPATRRAERDVREGEFLPRVADWFAANSGRFSEAMRERVKSIRQWK
SPARLAGLLRAWGDERVVGDEEIHAELVTWMREDSREWNSEAGQRARASRWRDDYYRCFVKRLAIEYRVVHVEDMD
LREIKRKPKAEEAESENQTARGNAFIASPGRLRELIREGFAETMSIDAAWTTQRCHACGEIDGFDAAAELVRTCRH
CGVTEDQDYRAAMNLLAGEQPDADEMAGVARGV (SEQ ID NO: 83)

>3300020203|Ga0163148_10001247_2
[aquatic-freshwater-freshwater microbial mat]
MSSRSKENRMFGHESKPTRNYVYGILAPTEGADLVDEQLRAAHQYRNNLVRLELDRREAVQQCLLAMRPAVARLTG
EVADAVTAYDAAAAALKVRNARERNKRASADERQASKDAADLLKGLRGQLKAVRTEAFAADDVRAALDAIETVERE
RRREARGASDVYWGTYLTVEQAAWSERSGAPPIEHRWTGEGRLAIQLQNGVEPAVLTLGQDKRLRIELTGEYGRGK
RGKRPLAVAWFRVGSDGHTPVWAKFPMVYHRPIPVDAKIKWAFVHRRRCGTFWRWQLMLSVARDAWESPITSGGSV
GIDLGWRVVPEGLRVASWAGDDGRRGELILPADDLRRWSEPATRRAERDVREGEFLPRVADWFAANSGRFSEAMRE
RVKSIRQWKSPARLAGLLRAWGDERVVGDEEIHAELVTWMREDSREWNSEAGQRARASRWRDDYYRCFVKRLAIEY
RVVHVEDMDLREIKRKPKAEEAESENQTARGNAFIASPGRLRELIREGFAETMSIDAAWTTQRCHACGEIDGFDAA
AELVRTCRHCGVTEDQDYRAAMNLLAGEQPDADEMAGVARGV (SEQ ID NO: 84)

>3300020213|Ga0163152_10009495_14
[aquatic-freshwater-freshwater microbial mat]
MSSRSKENRMFGHESKPTRNYVYGILAPTEGADLVDEQLRAAHQYRNNLVRLELDRREAVQQCLLAMRPAVARLTG
EVADAVTAYDAAAAALKVRNARERNKRASADERQASKDAAALLKGLRGQLKTVRTEAFAADDVRAALDAIETVASE
RRREARGACGVYWGTYLTVEQAAGSFRSGAPPIFHRWTGEGRLAIQLQNGVEPAVLTLGQDKRLRIELTGECGRGK
RPLAVAWLRVGSDGRAPVWAKFPMVYHRPIPVDAKIKWAFVHRRRCGTFWRWQLMLSVARDAWESPTTSGGSVGID
LGWRVVPEGLRVASWAGDDGRRGELILPADDLRRWSEPATRRAERDVRFGEFLPRVADWFAANAGRFGEEMRERVK
TIRQWRSPARLAGLLRAWSAERVTGDEEIYGELVRWMREDSREWNSESGQRARASRWRDDYYRCFVKRLASEYRVV
HVEDMDLREIKRKPKAEEAESENQTARGNAFIASPGRLRELIREGFAETMSIDAAWTTQRCHACGEIDGFDAAAEL
VRTCRHCGVTEDQDYRAAMNLLHGEQPDADEMAGVARGV (SEQ ID NO: 85)

>3300020213|Ga0163152_10009495_14
[aquatic-freshwater-freshwater microbial mat]
MFGHESKPTRNYVYGILAPTEGADLVDEQLRAAHQYRNNLVRLELDRREAVQQCLLAMRPAVARLTGEVADAVTAY
DAAAAALKVRNARERNKRASADERQASKDAAALLKGLRGQLKTVRTEAFAADDVRAALDAIETVASERRREARGAC
GVYWGTYLTVEQAAGSFRSGAPPIEHRWTGEGRLATQLQNGVEPAVLTLGQDKRLRIELTGECGRGKRPLAVAWLR
VGSDGRAPVWAKFPMVYHRPIPVDAKIKWAFVHRRRCGTEWRWQLMLSVARDAWESPTTSGGSVGIDLGWRVVPEG
LRVASWAGDDGRRGELILPADDLRRWSEPATRRAERDVREGEFLPRVADWFAANAGRFGEEMRERVKTIRQWRSPA
RLAGLLRAWSAERVTGDEETYGELVRWMREDSREWNSESGQRARASRWRDDYYRCFVKRLASEYRVVHVEDMDLRE
IKRKPKAEEAESENQTARGNAFIASPGRLRELIREGFAETMSIDAAWTTQRCHACGEIDGFDAAAELVRTCRHCGV
TEDQDYRAAMNLLHGEQPDADEMAGVARGV (SEQ ID NO: 86)

>3300020219|Ga0163146_10006198_18
[aquatic-freshwater-freshwater microbial mat]
MSVRVYKYGLRRPHEQGERVRAQMRAAHRYRNTLVEIERARRTAVRSAMSAYGNIGELEAAARSADVVVSDAVRLA
KAAKAEARSHSGVSSDQKAALLAARERKRDAVRLLRETRVLLRQDVVLSTEVDRVNELAAELRRNARKHCGVYWGT
YLLIEAADEAARKVPLYDGAEPSDPRFMRWAGEGRVGVSTAKGADIAVLDDTKDTRIRIEPGTMPKGADPASKRSA
KRRHAVLAMRVGSGDQREPVFARWEMVMHRSLPAGARIKNAAVSLRLVGPREEWSVAITLDTTACAETATRGRGVV
GVDLGWRMLNGDIRSAAWDGGDVSGFLALPAELIGQVEKVADLRSIRSKNFDASRAALVAAMPADAPAWLRGATAS
LGQWKSIDRLTKLALRWRVAREDGDAAAYDALEAWRYNDHHLWCWESEQRTRTLRHRRETYRIFAAKLAREYETLA
IENFDLRVESVRAPVETDASIDTVTRAARVVVSPSELRLSLVNAFGPHRVVKVDAANTTRECSECHHINTWDAAAE
LSHTCAQCGARWDQDANAARVIRARGTAASPAPGAARNGDSANDSAAPIESRWAKAKRMRAEKRSGEGGARKPVDA
AAE (SEQ ID NO: 75)

>3300020596|Ga0163149_10010333_13
[aquatic-freshwater-freshwater microbial mat]
MSVRVYRYGLRRPHEQGERVRAQMRAAHRYRNTLVEIERARRTAVRSAMSAYGNIGELEAAARSADVVVSDAVRLA
KAAKAEARSHSGVSSDQKAALSAARERKRDAVRLLRETRVLLRQDVVLSTEVDRVNELAAELRRNARKHCGVYWGT
YLLIEAADEAARKVPLYDGAEPSDPRFMRWAGEGRVGVSTAKGADIAVLDDTKDTRIRIEPGTMPKGADPASKRSA
KRRHAVLAMRVGSGDQREPVFARWEMVMHRSLPAGARIKNAAVSLRLVGPREEWSVAITLDTTACAETATRGRGVV
GVDLGWRMLNGDIRSAAWDGGDVSGFLALPAELIGQVEKVADLRSIRSKNFDASRAALVAAMPADAPAWLRGATAS
LGQWKSIDRLTKLALRWRVAREDGDAAAYDALEAWRYNDHHLWCWESEQRTRTLRHRRETYRIFAAKLAREYETLA
IENFDLRVESVRAPVETDASIDTVTRAARVVVSPSELRLSLVNAFGPHRVVKVDAANTTRECSECHHINTWDAAAE
LSHTCAQCGARWDQDANAARVIRARGTAASPAPGAARNGDSANDSAAPIESRWAKAKRMRAEKRSGEGGARKPVDA
AAE (SEQ ID NO: 87)

>3300020596|Ga0163149_10010333_12
[aquatic-freshwater-freshwater microbial mat]
MRAAHRYRNTLVEIERARRTAVRSAMSAYGNIGELEAAARSADVVVSDAVRLAKAAKAEARSHSGVSSDQKAALSA
ARERKRDAVRLLRETRVLLRQDVVLSTEVDRVNELAAELRRNARKHCGVYWGTYLLIEAADEAARKVPLYDGAEPS
DPRFMRWAGEGRVGVSTAKGADIAVLDDTKDTRIRIEPGTMPKGADPASKRSAKRRHAVLAMRVGSGDQREPVFAR
WEMVMHRSLPAGARIKNAAVSLRLVGPREEWSVAITLDTTACAETATRGRGVVGVDLGWRMLNGDIRSAAWDGGDV
SGFLALPAELIGQVEKVADLRSIRSKNFDASRAALVAAMPADAPAWLRGATASLGQWKSIDRLTKLALRWRVARED
GDAAAYDALEAWRYNDHHLWCWESEQRTRTLRHRRETYRIFAAKLAREYETLAIENFDLRVESVRAPVETDASIDT
VTRAARVVVSPSELRLSLVNAFGPHRVVKVDAANTTRECSECHHINTWDAAAELSHTCAQCGARWDQDANAARVIR
ARGTAASPAPGAARNGDSANDSAAPIESRWAKAKRMRAEKRSGEGGARKPVDAAAE (SEQ ID NO: 88)

>3300004174|Ga0066406_1000030_21
[aquatic-freshwater-freshwater sediment]
MIRVYKYGIKPPFDFGEDCVDELRRMNNYWNRLVEIDREREVAFRNLCRSWSPEYATAMDRIDALKQPIDAIYEEI
RATRVKNRNKELPDEIKVRDRLLGERKVLWETCKAIQKKLPKDLQEPLIQKYKTDCKLARQQSGLYWGNYNAVSE
SFETAKSRTIKEGGRLHFRLFDGAGRFVNQIQGGMTAVDLFTGAKSQAKCSASVIRKSRGGTPHHSFTFTAFTGRD TABLE 2-continued Amino Acid Sequences of Representative CLUST.018837 Effector Proteins*

VDGKRFRRELTADLAYHRPIPAEGTIKSIEIVRDIIDGHEKWHVCFTVSLPDIEIEHPKRNIAGVNMGWRQIGSAL
RIAVIVDDKNQKREYFLPATVAHKFEHAESIQAKADEAENEMLVWLREIYQAANQAPQEWKEAVQGVLRNRPARDA
YAKLLSEWEGAQDLINGFDEYKAWHKENKKLHRYYAGTRRRAIAWREEIYRSIAKEIAENYAVIAITDTPLSQMSR
TKSSGGLSIDNALPPAARRNRVIAGIYTLKEWIDKQAAKTGAVVEKITDKVTQTCHKCSAIADKRVGSERYITCTN
CESELEVDENAAINSRKLASGEVTPKKELRKAAKYQRVREAMNAKNDSARKMADNSSDGVA (SEQ ID NO: 89)

>3300004200|Ga0066422_1000628_7
[aquatic-freshwater-freshwater sediment]
MIRVYKYGIKPPFDFGEDCVDELRRMNNYWNRLVEIDREREVAFRNLCRSWSPEYATAMDRIDALKQPIDAIYEEI
RATRVKNRNKELPDEIKVRKDRLLGERKVLWETCKAIQKKLPKDLQEPLIQKYKTDCKLARQQSGLYWGNYNAVSE
SFETAKSRTIKEGGRLHFRLFDGAGRFVNQIQGGMTAVDLFTGAKSQAKCSASVIRKSRGGTPHHSFTFTAFTGRD
VDGKRFRRELTADLAYHRPIPAEGTIKSIEIVRDIIDGHEKWHVCFTVSLPDIEIEHPKRNIAGVNMGWRQIGSAL
RIAVIVDDKNQKREYFLPATVAHKFEHAESIQAKADEAENEMLVWLREIYQAANQAPQEWKEAVQGVLRNRPARDA
YAKLLSEWEGAQDLINGFDEYKAWHKENKKLHRYYAGTRRRAIAWREEIYRSIAKEIAENYAVIAITDTPLSQMSR
TKSSGGLSIDNALPPAARRNRVIAGIYTLKEWIDKQAAKTGAVVEKITDKVTQTCHKCSAIADKRVGSERYITCTN
CESELEVDENAAINSRKLASGEVTPKKELRKAAKYQRVREAMNAKNDSARKMADNSSDGVA (SEQ ID NO: 89)

>3300004205|Ga0066415_1000057_23
[aquatic-freshwater-freshwater sediment]
MIRVYKYGIKPPFDFGEDCVDELRRMNNYWNRLVEIDREREVAFRNLCRSWSPEYATAMDRIDALKQPIDAIYEEI
RATRVKNRNKELPDEIKVRKDRLLGERKVLWETCKAIQKKLPKDLQEPLIQKYKTDCKLARQQSGLYWGNYNAVSE
SFETAKSRTIKEGGRLHFRLFDGAGRFVNQIQGGMTAVDLFTGAKSQAKCSASVIRKSRGGTPHHSFTFTAFTGRD
VDGKRFRRELTADLAYHRPIPAEGTIKSIEIVRDIIDGHEKWHVCFTVSLPDIEIEHPKRNIAGVNMGWRQIGSAL
RIAVIVDDKNQKREYFLPATVAHKFEHAESIQAKADEAENEMLVWLREIYQAANQAPQEWKEAVQGVLRNRPARDA
YAKLLSEWEGAQDLINGFDEYKAWHKENKKLHRYYAGTRRRAIAWREEIYRSIAKEIAENYAVIAITDTPLSQMSR
TKSSGGLSIDNALPPAARRNRVIAGIYTLKEWIDKQAAKTGAVVEKITDKVTQTCHKCSAIADKRVGSERYITCTN
CESELEVDENAAINSRKLASGEVTPKKELRKAAKYQRVREAMNAKNDSARKMADNSSDGVA (SEQ ID NO: 89)

>3300004565|Ga0066503_104695_4
[aquatic-freshwater-freshwater sediment]
MIRVYKYGIKPPFDFGEDCVDELRRMNNYWNRLVEIDREREVAFRNLCRSWSPEYATAMDRIDALKQPIDAIYEEI
RATRVKNRNKELPDEIKVRKDRLLGERKVLWETCKAIQKKLPKDLQEPLIQKYKTDCKLARQQSGLYWGNYNAVSE
SFETAKSRTIKEGGRLHFRLFDGAGRFVNQIQGGMTAVDLFTGAKSQAKCSASVIRKSRGGTPHHSFTFTAFTGRD
VDGKRFRRELTADLAYHRPIPAEGTIKSIEIVRDIIDGHEKWHVCFTVSLPDIEIEHPKRNIAGVNMGWRQIGSAL
RIAVIVDDKNQKREYFLPATVAHKFEHAESIQAKADEAENEMLVWLREIYQAANQAPQEWKEAVQGVLRNRPARDA
YAKLLSEWEGAQDLINGFDEYKAWHKENKKLHRYYAGTRRRAIAWREEIYRSIAKEIAENYAVIAITDTPLSQMSR
TKSSGGLSIDNALPPAARRNRVIAGIYTLKEWIDKQAAKTGAVVEKITDKVTQTCHKCSAIADKRVGSERYITCTN
CESELEVDENAAINSRKLASGEVTPKKELRKAAKYQRVREAMNAKNDSARKMADNSSDGVA (SEQ ID NO: 89)

>3300009686|Ga0123338_10029047_2
[aquatic-freshwater-glacier valley]
MNNSTPTNPSERSEPLAALERVRVVQFGACAPTAGWEAGFLQHRLRTRFWNAICEIERNHRDTVQAIVGPLKEAGM
PSKDAYASEDVQALELARKGKRLVARQEAAQGGLFWTGYLEVERAMDTARRGLEPPRFKRFEAHEGKLNFLFTNGL
ASSELCGDDLRVQFEPLELPEGCSARTRKANPYHVKLRVCSQDKVLEVAYLHRPIPEGSVRDVALIWRREGA
KQRYSLSVTVREGGVIHAPAPFERAAINIGWKRLTHGLRVAYWRGTDGKHGEIVLSNAWLERYHHALGIESVRAKP
LNSIKEQMLAYFRTTPDVPEEMATRVTHLAQWRSAARFAVLYKFWVQRWHGDDAGFNALEAWHKRDVHLWQYGEG
TSARLMRSRREQYRTFAAKMLERYGEIVMDKLDLRIFAELEARGDDLAPIARAQRVQAAPSTLRLALQNAYGREGR
VVSWVGARTSSTCHVCRAPVVLGRDLIHTCQGCQSHWDVDDNACSNLLREPEAGIKIPKASRSPRARKNLALGTAV
GAD (SEQ ID NO: 90)

>330000124210687J13896_1000006_134
[aquatic-freshwater-groundwater]
MKRSKSDKSARVYKEGSPLKTAVESEVAMEQLRLQNREWNALVEADKVETEKYWAIRDGADARLPVLRKQIEDIKV
RTEEIRTEIKKGRQDGIKGTPSDLKAEIVELKAQKKPLIAEKKEIWAFVKDTVKPQLHELDGERYDKNVAIRQEYA
QNGLYWGNYLAVMDSFETARMAIMKTQVEDGQKRPELQFHRFERVGRWTCQIQGGMNITQAFLGSNNYFQIDRLPA
DAWTHPSRGERGRLKRTKARIRIGSGEKKTVPIWLEIPIVMHRPIPESAEIKSVSIHVSKLADKFVWSLTVTVRED
CSVPLERTGHCVAINIGWRAKGLATRIAYMLDSRGVEEEILLGSEYTVSNEKAASLQGIRKKNENETVAWFNEWKK
ANADIVPPWLSERTKMMMSWKSEAQLASVAIQWSGRGERREGDPPEFREHGDEEAFNKIEAWRKQDKHLWQWHANL
SDRIRGRRLCEYRKIALKLSKEYDVVIQEDFDLRKTKGKKKAEEGADNDDHIRRMSDLASVSTERTETIRAMRSAG
KEHVKLDSKNITKTCPFCGGTIKPGRKTNIMVQCSKCGKVYDQDWAASKNLLTAYLDSSGDVPPETP (SEQ ID
NO: 91)

>3300005236|Ga0066636_10020712_3
[aquatic-freshwater-groundwater]
MTRVFEYGLPFDPPFDGAELVDEQILLAHRYYNKLIELEHTRRSSILAVQRADPKVGPLLAAYDAANAEVEDLLARK
REAKSRDRRVAAPELSEIEAAKEARRHLSVQLRKVKKVATDRLKPEYDLAEQATRDAKKAARAASGVFWGTYSLIE
QAADAAAKAKPVLRPGTHPRPWDQQPSFRRWTGEGMVAVQININRPLNDVTVEGDDLRLRITPVDPAAWSDATSRG
DRKCLARTNVTMRVGRNTGETATWPMVMHRPLPAGSRVTWAKVLRRRLDDRPHWFKYVLQLTVETADAPRHPGLVS
LPPAIVAINCGWRALPNGSLRVVTWVGSDGAEGVLDLGCREYRDRIERAESIRSVRDQLRNELTSKLVGIGIDVTR
WRSFDREHRLFRELTAEGCERNEAVELLEAWHHRDRHLRQYQDGARGGALRFRREQYRLLAVELARRYPVVCVESW
DLRPVVTDEDRLPGPAAARVEGASSTARLALASAATREGCVVLTQIAAHVRLQTQTCHVCGYGAKKGEEWDAAAEL
VHTCEGCGETWNQDVNECRNILAASRAAVTEIPELLVPKIMKRSARFAARHKKVAT (SEQ ID NO: 92)

>3300014208|Ga0172379_10007070_15
[aquatic-freshwater-groundwater]
MRVYRYGLLRPTDEQELGLVREQMRLANKYRNWLVWLERGYRMALSELVDAHPSVAPFLSETEASEVKVDAKEVKI
RRKRKATRSRSESTEDRQEVATERVSLTERRNALSAARWAALKGPLKAEAKRMNDLWEEMQKETRRQSVCGVFWGT
SQIQDLAMKESRKALLWYRGKLALPDFVRWSDNQSVGVQVQDNIPPEDLFRQGSLVRIAPVSPQAWSEAVPRGDRK TABLE 2-continued Amino Acid Sequences of Representative CLUST.018837 Effector Proteins*

RLQRTVLSLRVQSDAKRQPVWAHWPMIMHRAIPAGCVVTRVAVRCRMIGPREEWYATITVDDSKAETAQPCGNGTV
AMDLGWRAMKGGGIRVARWRDSDGGSGEFQLDEHIVSSLRKAEGLHATRDDNFNEARAKLQKWLAGAPDVPGWLRL
DTETLGSWRSLERLQALAGKWKKNRFAGDEEGYAALEQWHYHDYHLWQWESDQRAKSLRHRRELYRIFAAKMACRY
STLVLEDFEIPGVAKKPTVEEDSEYNKNAAHNRQLASPHEFRECMKAAFVARDGMVQLLPCADTTRHCSVCGSLEL
FDQAKHLWHTCLACEGEGRATTWDQDDNAAQNLLDLWQNGADPVKTVSKALALANKREPAWIKAKRLARAKREADA
SGAVVQQPTEALEAE (SEQ ID NO: 93)

>3300014208|Ga0172379_10014650_2
[aquatic-freshwater-groundwater]
MGLVSGIKVYRYGLLAPTENAHLVGEQMWLAHRYQNTLIEIERARRAALRAVYVAHGDVAAMTAVCQAATAEVARL
YRDAKAARSQSRKRQIPSEIGDALKVAKEASREAQARLRAARLAIKTDPSVVASREQIEERAAWLRRNARAYCGVY
WGTYLGIESAVSQTAKMPLYDGSEPNDPRFSRWEHEGTVGVQLQGGLAGAGAMRCDDTRLRIEVGTAPKGVDPTSR
RSATRRYMVLAMRVDSDGRDPVWARWPMKMHRPLPDDAVIKWAHVHRRRRGPHDEWSVTLTIETSAARPAAPTGAV
GIDLGWRSLDTDGIRVAAWHGSDGRSGTLVLSEWDLSRLEKANDLRSIRDKKEDAARAALSTWLENACVPAWFHEA
TAHLVQWKSIERLMGLVRRWKGSREGGDDAAYEALEAWRYNDHHLWAWEAHQRVRALRNRREIYRVFAARMAREYH
TVVLEDWNISKIAKRPAVDEETVADGNKNSRTARQSVAVSELRLALTHAFGARVEKVPCAFTTRDCHACGSVESWD
QAAELVHTCSSCGVVWDQDANAAQNLLARFAARGGGDLDNAGTARGNETMNASETLKESRWARAKRVKAERIASDQ
VARE (SEQ ID NO: 94)

>3300014613|Ga0180008_1000021_8
[aquatic-freshwater-groundwater]
MIPDGKRKGEKRMILIYEYGIPFDPMEGHDFVEDQILMAHRYYNKLIEIERAKRARIRAIQQAHPILGPLVTESDE
THELENDIIDRQKKAKSKDNRYPEVDPEEWEAAKEISAEVRLRLTAAKAAVKAELTPAYEAASQEAKDRKRLARAN
SKVYWGTYLITEAAAEAAVNAKPKSRPGKVPPPWHMCPAFRRWNGEGSLAVQIQKPKALTEVTVFGHDNQFRITPV
DPYAWDKSTPRGLRCRLGRTTFTMRVGMKRGETASERMVMHRPLPPGSRITWAKIIRRRVDDRLYRFRYFLQLTVE
TTLCVRHPGLDNADPVSIPVVAINCGWRALADGSLRVATWLGSDNRTGTLELGREEFRDRIERAESIRSRRDIDLD
ELKKAIEGFGEIFKSMEVECVEKWKSFSRFHGLYCDVLTEYAENPTEEKKELLELLTSWHHRDRYLMQYENGCRGG
ALRFRREKYRLFALELAKAYPVVCIESWDLRRIVEDEHRLKEPSAARVEGASSIARQITRNTSLREGCVVLKQGDK
EVELATQRCHLCGYGAKKRERWDAAKELVHVCGGCGAEWNQDVNFCENILTTSRGDLVGAPQLLEPKIVIQLGRFQ
KRAAAKREREAAQADEQEE (SEQ ID NO: 95)

>3300014613|Ga0180008_1000021_9
[aquatic-freshwater-groundwater]
MIPDETTTSLFAGKLSDPGRNSHRHCSPGNLVIPDGKRKGEKRMILIYEYGIPFDPMEGHDFVEDQILMAHRYYNK
LIEIERAKRARIRAIQQAHPILGPLVTESDETHELFNDIIDRQKKAKSKDNRYPEVDPEEWEAAKEISAEVRLRLT
AAKAAVKAELTPAYEAASQEAKDRKRLARANSKVYWGTYLITEAAAEAAVNAKPKSRPGKVPPPWHMCPAFRRWNG
EGSLAVQIQKPKALTEVTVFGHDNQFRITPVDPYAWDKSTPRGLRCRLGRTTFTMRVGMKRGETASFRMVMHRPLP
PGSRITWAKIIRRRVDDRLYRFRYFLQLTVETTLCVRHPGLDNADPVSIPVVAINCGWRALADGSLRVATWLGSDN
RTGTLELGREEFRDRIERAESIRSRRDIDLDELKKAIEGFGEIFKSMEVECVEKWKSFSRFHGLYCDVLTEYAENP
TEEKKELLELLTSWHHRDRYLMQYENGCRGGALRFRREKYRLFALELAKAYPVVCIESWDLRRIVEDEHRLKEPSA
ARVEGASSIARQITRNTSLREGCVVLKQGDKEVELATQRCHLCGYGAKKRERWDAAKELVHVCGGCGAEWNQDVNF
CENILTTSRGDLVGAPQLLEPKIVIQLGRFQKRAAAKREREAAQADEQEE (SEQ ID NO: 96)

>3300014656|Ga0180007_10000195_44
[aquatic-freshwater-groundwater]
MIPDGKRKGEKRMILIYEYGIPFDPMEGHDFVEDQILMAHRYYNKLIEIERAKRARIRAIQQAHPILGPLVTESDE
THELFNDIIDRQKKAKSKDNRYPEVDPEEWEAAKEISAEVRLRLTAAKAAVKAELTPAYEAASQEAKDRKRLARAN
SKVYWGTYLITEAAAEAAVNAKPKSRPGKVPPPWHMCPAFRRWNGEGSLAVQIQKPKALTEVTVFGHDNQFRITPV
DPYAWDKSTPRGLRCRLGRTTFTMRVGMKRGETASFRMVMHRPLPPGSRITWAKIIRRRVDDRLYRFRYFLQLTVE
TTLCVRHPGLDNADPVSIPVVAINCGWRALADGSLRVATWLGSDNRTGTLELGREEFRDRIERAESIRSRRDIDLD
ELKKAIEGFGEIFKSMEVECVEKWKSFSRFHGLYCDVLTEYAENPTEEKKELLELLTSWHHRDRYLMQYENGCRGG
ALRFRREKYRLFALELAKAYPVVCIESWDLRRIVEDEHRLKEPSAARVEGASSIARQITRNTSLREGCVVLKQGDK
EVELATQRCHLCGYGAKKRERWDAAKELVHVCGGCGAEWNQDVNFCENILTTSRGDLVGAPQLLEPKIVIQLGRFQ
KRAAAKREREAAQADEQEE (SEQ ID NO: 95)

>3300014656|Ga0180007_10000195_48
[aquatic-freshwater-groundwater]
MIPDETTTSLFAGKLSDPGRNSHRHCSPGNLVIPDGKRKGEKRMILIYEYGIPFDPMEGHDFVEDQILMAHRYYNK
LIEIERAKRARIRAIQQAHPILGPLVTESDETHELFNDIIDRQKKAKSKDNRYPEVDPEEWEAAKEISAEVRLRLT
AAKAAVKAELTPAYEAASQEAKDRKRLARANSKVYWGTYLITEAAAEAAVNAKPKSRPGKVPPPWHMCPAFRRWNG
EGSLAVQIQKPKALTEVTVFGHDNQFRITPVDPYAWDKSTPRGLRCRLGRTTFTMRVGMKRGETASFRMVMHRPLP
PGSRITWAKIIRRRVDDRLYRFRYFLQLTVETTLCVRHPGLDNADPVSIPVVAINCGWRALADGSLRVATWLGSDN
RTGTLELGREEFRDRIERAESIRSRRDIDLDELKKAIEGFGEIFKSMEVECVEKWKSFSRFHGLYCDVLTEYAENP
TEEKKELLELLTSWHHRDRYLMQYENGCRGGALRFRREKYRLFALELAKAYPVVCIESWDLRRIVEDEHRLKEPSA
ARVEGASSIARQITRNTSLREGCVVLKQGDKEVELATQRCHLCGYGAKKRERWDAAKELVHVCGGCGAEWNQDVNF
CENILTTSRGDLVGAPQLLEPKIVIQLGRFQKRAAAKREREAAQADEQEE (SEQ ID NO: 96)

>3300014656|Ga0180007_10004731_7
[aquatic-freshwater-groundwater]
MFGHESQPSRIYAYGAKAPVVNGERVGEQIWLGHRYRNTLAEIELRRREQTDKMVVTLSPELPGVEAKLLEADQAI
ESAAAEIKLANKQARRQKATPEQKTKLAALRKERAALRKKRKALRDVVESDSGTHDALTGIDQRAAAEQREARAES
GLYWGTYLTVEQGCQSFRKGRPPRFLRWTGEGRIAVQVQGGLAPEDAFGGEDKRLIVEPLPEDAWSKRSRGLKRTK
AWLRIGSDDDRQPVWAVVPFVMHRSLPADCRIKWVYLHRRRVGTKDQWMLSFVIARQVWPQTDVAGSGEIGIDLGW
RLLDHGLRVAAWAGSDGESGELVLPIQDVGRWQKAQDLRGIRDTRLDAVIARFGEWLSGNDAPDWLTERTRTLRQW
RSAARLASVVLAWRDQRFAGDESIYADLEAWRKKDKHLYEWEANQRRKAVAWLKDLYRNFAAAMARRYRVAVLEAV
NWRDMGRRAGVGESDKAGAARRQRVIASPGRLAECIRERFADCVSAPAEYTTQRCHACGEIDGFDARVEIVHTCGK
CGKTWDQDYNAARNLLAFASGPVAKKTR (SEQ ID NO: 97)

TABLE 2-continued

Amino Acid Sequences of Representative CLUST.018837 Effector Proteins*

>3300014656|Ga0180007_10004731_5
[aquatic-freshwater-groundwater]
MMFGHESQPSRIYAYGAKAPVVNGERVGEQIWLGHRYRNTLAEIELRRREQTDKMVVTLSPELPGVEAKLLEADQA
IESAAAEIKLANKQARRQKATPEQKTKLAALRKERAALRKKRKALRDVVESDSGTHDALTGIDQRAAAEQREARAE
SGLYWGTYLTVEQGCQSFRKGRPPRFLRWTGEGRIAVQVQGGLAPEDAFGGEDKRLIVEPLPEDAWSKRSRGLKRT
KAWLRIGSDDDRQPVWAVVPFVMHRSLPADCRIKWVYLHRRRVGTKDQWMLSFVIARQVWPQTDVAGSGEIGIDLG
WRLLDHGLRVAAWAGSDGESGELVLPIQDVGRWQKAQDLRGIRDTRLDAVIARFGEWLSGNDAPDWLTERTRTLRQ
WRSAARLASVVLAWRDQRFAGDESIYADLEAWRKKDKHLYEWEANQRRKAVAWLKDLYRNFAAAMARRYRVAVLEA
VNWRDMGRRAGVGESDKAGAARRQRVIASPGRLAECIRERFADCVSAPAEYTTQRCHACGEIDGFDARVEIVHTCG
KCGKTWDQDYNAARNLLAFASGPVAKKTR (SEQ ID NO: 98)

>3300015370|Ga0180009_10002661_7
[aquatic-freshwater-groundwater]
MQAKVYVYGLRPPTHEAERVAEQLHLAHRYRNDLVAIERKRRERVAALLSASGLSAHEERLEAAEQVLEAALSSLR
AVRQAACKRAETSEQREAVKAARADVKAFREQLKEERKQLRPTLSAETETINDGAADERRAARAVCGVYWGTYLLI
EQADEQARKSPTPPQFQRWTGEGAVGVQLQGGLDTDTVFGADTRLQIDPVPPTAWDRRRSPERRTRVRLRVGSDGR
APIWAEWPVTLHRPLPTGEIVWAKVLRQRVEAKSEWGLHLTIRVEDPTPTARSGAVGVDLGWRLREDGLRSGYWVG
SDGEHGEILVDQRTLDRLQKVKSLCSIRDRNLDELRPWLAEWLRARRAGLPEWLRERTQYLHTWKAPRKFNALSVA
WRAQRFPGDGEAVERLEAWRKQDKHLWTWETHQRERTLRCRREGYRLLAATLAERYGVLVLEDLDLRVFQQRRPAE
AEQGECQPARSQQPVAATSILRSCLINAFEAVGGRVVKLDPAGTTKECWLCGGTAWSVQAEESVDRTCRECAALVD
QDENAGRVLLARFERSGGIAGSADPDTSKSGQLRVSGGRWQRRKERCSKSGTQDCTA (SEQ ID NO: 99)

>3300009760|Ga0116131_1003961_2
[aquatic-freshwater-peatland]
MKRKTSLVPTKVYRYGLLSPTSNGRLVDETIYRGHQFYNRLIEIERARRAEYRAERTRRFPELATVESLVEDLTKQ
IETMRTAIVATKIATQSRAVATDSAAELKRLRDERKIAHDRLVEMRAACKSDLDFSAWVKIANEKAYGLVKAARNS
CGVAWGTYNLIAASAQQASATSTMDPEFRRYDGEGRIGVQIIGGMSVADLATDTQLQIAMPEFHDGMTRGEWRRAS
RTVVKMRVGSDENRRPIWAEFPAVIHRPLPEDARIMSAVITRRRLGVERRWEYSLCISCESNKFDRTLPGLKQEGT
ATINFGWRQFSDGFRVATVNNDVTGIEEIRLPKTITDRFSKCEDLRSIIDMRFNIVRAELQEWLASHKADCPEWLT
TSLEFLHLWKQPERLDRVVGNWAGLRFAADADIYSILADWRTKYRHLQDWQMMNRRQGLNMRKEFYRLVASRLAQH
NAKLVVEAFDVRQVAVLPRPEEVASGGTAARHNRFLVAVGNLRSSILLAAQKYHCAVDVVKATNNTRRCNVCGKLL
DWDPAKTVNRECPECSTWDQDVNATDNAVDRVASGEVVTMIAPAELAENGSIRPATKRSWGAARNELDKMPSLL
(SEQ ID NO: 100)

>3300018019|Ga0187874_10017489_1
[aquatic-freshwater-peatland]
MSAILVYKFGLLRPVDNATMVHQQVRAAHDYRNDLTMIERGRRAAIRSVLESEPDVAAALTGARAARALLDAALAV
VASARASARTRAAGAPATGDVKSVRAVLHAAEGTFRQALQAVRTRSHVVSETDRINERAGELGRSARAHCGVYWGT
YLLIEADMQASRKMPLYDGVEPNDPRYQRWTGKGRLGVQIQKGMSASAVEGADTRIRIDPVNERAWPATSTLGWSE
RRRLQHTTLHLRVSSDGAAPIWAAWPMSMHRPFPEGARIKWAVNLRRVAGREEWTVCITLDVTDTQRAQCCGEGA
VAVDLGWRLLCQPQAHNETGLRVGTWRGEDGAAGTMTLSHHWSGGELKARELRSIRDKAFEAARDALAVWLASPGD
RPAWLAAKTRALGQWRSAHRLAAVAQWWAAHRFDGDAQAFAALETWRYHDHHLWQWETHQRETTLRDRREQYRIFA
AGLARRYRTLVLEAFDLRKLARLPAPEQVDGEAQAPRSQRQLVAPSELRDALVKAFVARGGEVVEVSAVDSTRICH
ACGVVELWDQAAELRHTCSACGVEWDQDDNAGANLLTRYRERPSGDETPGPARKAEKTGKEGSKWARAKALRAERD
TRTGAARKALAKCAE (SEQ ID NO: 101)

>3300018025|Ga0187885_10005575_2
[aquatic-freshwater-peatland]
MEDVDLQYRMRYSCHNDLVAVELERRYTFRAYRSTLPEYAVVEQPYLELKKQRDAVREEIKLIRQKSRTRVETPEQ
NARVAALNAELKKQDVFLKIAAKKVSGDLGLVAVGKEADEVAKAATKAILDDYAARGLTWGTRALVVQELQAAKNA
ERDPKIHPWDNSGRIGLQLQGKNLSEEMVASGKHIASEQKRLRAMTKELGKKSKVVESFAERLLKMKQDRYAQKTP
ENRGLPISGLADDTRLQIVVPPEIAYQAASTRRGDRRRAARTTMKMRIGSTPKNAPIWMECKVTMHRQLPADGIIK
WAWIRKKMLGTHEIYHLQLIIEAPSFEQKIAVADRMEAIAVDVGWRVREKNVLRIAYLVDTAGNRKEILLPTSIVE
KLKHADSLRGKEDDAFNAIQDRLMEWIGLNKPILPAWFQDTFQFLAQSRSSKNLAWNVREWGRRRFAGDTLIYEEM
TAWRRQFLHLYEWETNERAKAMGERKNFFRHVGLDLARSAHNVLLEDFKLAKIVENAQPEEDDDNPQTQRHNRVMS
AISEFRQAIASACSAWRSTLWKLPAAYTTQDCHACHQEKDKHSKWDAAPAIVHTCQEKCGKTWDQDYNASMNLLGA
WLRSRRTNRAA (SEQ ID NO: 102)

>3300018025|Ga0187885_10005575_1
[aquatic-freshwater-peatland]
MVRKSTEDPTRIWSFRITEITSPMEDVDLQYRMRYSCHNDLVAVELERRYTFRAYRSTLPEYAVVEQPYLELKKQR
DAVREEIKLIRQKSRTRVETPEQNARVAALNAELKKQDVFLKIAAKKVSGDLGLVAVGKEADEVAKAATKAILDDY
AARGLTWGTRALVVQELQAAKNAERDPKIHPWDNSGRIGLQLQGKNLSEEMVASGKHIASEQKRLRAMTKELGKKS
KVVESFAERLLKMKQDRYAQKTPENRGLPISGLADDTRLQIVVPPEIAYQAASTRRGDRRRAARTTMKMRIGSTPK
NAPIWMECKVTMHRQLPADGIIKWAWIRKKMLGTHEIYHLQLIIEAPSFEQKIAVADRMEAIAVDVGWRVREKNVL
RIAYLVDTAGNRKEILLPTSIVEKLKHADSLRGKEDDAFNAIQDRLMEWIGLNKPILPAWFQDTFQFLAQSRSSKN
LAWNVREWGRRRFAGDTLIYEEMTAWRRQFLHLYEWETNERAKAMGERKNFFRHVGLDLARSAHNVLLEDFKLAKI
VENAQPEEDDDNPQTQRHNRVMSAISEFRQAIASACSAWRSTLWKLPAAYTTQDCHACHQEKDKHSKWDAAPAIVH
TCQEKCGKTWDQDYNASMNLLGAWLRSRRTNRAA (SEQ ID NO: 103)

>3300018057|Ga0187858_10035455_2
[aquatic-freshwater-peatland]
MSAILVYKFGLLRPVDNATMVHQQVRAAHDYRNDLTMIERGRRAAIRSVLESEPDVAAALTGARAARALLDAALAV
VASARASARTRAAGAPATGDVKSVRAVLHAAEGTFRQALQAVRTRSHVVSETDRINERAGELGRSARAHCGVYWGT
YLLIEADMQASRKMPLYDGVEPNDPRYQRWTGKGRLGVQIQKGMSASAVEGADTRIRIDPVNERAWPATSTLGWSE
RRRLQHTTLHLRVSSDGAAPIWAAWPMSMHRPFPEGARIKGAVVNLRRVAGREEWTVCITLDVTDTQRAQCCGEGA
VAVDLGWRLLCQPQAHNETELRVGTWRGEDGAAGTMTLSHHWSGGELKARELRSIRDKAFEAARDALAVWLASPGD
RPAWLAAKTRALGQWRSAHRLAAVAQWWAAHRFDGDAQAFAALETWRYHDHHLWQWETHQRETTLRDRREQYRIFA TABLE 2-continued Amino Acid Sequences of Representative CLUST.018837 Effector Proteins*

AGLARRYRTLVLEAFDLRKLARLPAPEQVDGEAQAPRSQRQLVAPSELRDALVKAFVARGGEVVEVSAVDSTRICH
ACGVVELWDQAAELRHTCSACGVEWDQDDNAGANLLTRYRERLGGDETPGPARKAEKTGKEGSKWARAKALRAERD
TRTGAARKALAKCAE (SEQ ID NO: 104)

>3300012183|Ga0136624_1011435_1
[aquatic-freshwater-polar desert sand]
MSTLVYAYGCAPNTPICEEVDEQLHLAHEFYNKLVELEIRHENALDAMWREYPDIASMMDQIDTTDLIITELKKRG
KAERVENVSTVTSEPLALELKRAKRGQKETRAALRTAKNRIKEDVALPKKHLLAEHQARAKAARIDFAHRGLYWGT
YNRVWADMKVAVEGVIRKRTGGEPARLHFRRWDGTGTLAVQLQRQDGDPPRDPQGLAEGTTKWRNVFSVAPWMPPA
EFDSMTRPAQLRIAEQGRVRMNVGASRVVKIPVLVHRMLPPDADVLGASLTVTRVAGRRRASVSVIVNLPDAAPVG
DDGPRVSVTLGWSSVPHGIQVAKLSADRPLRIPADIADLVHRGPDPHTTEITVPAAWCNRLDSAMGLQSRRDTALD
AIRSELVEYLRAHPDTSDRPITTTEVARWKAPARFAAVALRWRNMPPLPHGKMIAATLEAWRRTDRRRWEAETHTR
RRALGCRRDGYRRVAAWLARECSEVTMSSTDLSKLAHRTEVGASASNAVPEEVAQLARQQRVLVAPSELRESIVAA
CRREGVSVASGAVRAPVSENARSA (SEQ ID NO: 105)

>3300012682|Ga0136611_10000100_4
[aquatic-freshwater-polar desert sand]
MKSTLNWCYGAKTPDIEQAVSDAIFAAHTYRNQLCALELEKRARHYQVLVELSPDYVAACDAVTLVEVAAQAVEDL
ITAEKVTQRTQTPKNIKHLRDRATALAAELQVKRAVRKVAQCSAYAMPAVIAALDRSTAQHKAARKQAKQASGLYW
GTEATVTESCRDFHKGPPPTFKRYDGTGQLSVQLQGGLDCADAERYNTLCYLGDSLGGKRRECFIRIGSDNRAPVF
ACVPIVEHRALPAGEIKRAYLERRKIASHVRWTIRFTIDIERDIPDRPMPGEVAIHTGWRMEEGSLRVATWLASDG
STGTLRLSQEHCADYLRLDSLEANRAAGLNEVIAELRTWAKSRELPEFLTEVKPHLHLWKSQARLAKLVWHWAEAR
FDGDSAMFERLDSWRKTDKHLWQHHRRLTVRISRRRRDAYRVFAKSLSERYGVAILAPIQVQKLTKKPTETRPPED
WELDQTQSRRHAAWAAVSDLTSCIRERFPLRCITVSSVNMTKECVNCGEINKADGRKIQCRGCGQTYDCDDNAVAN
TLARGDAALLDGALLALVTEQELKEAAKQAKLVKLQEANNAARTTRQTDL (SEQ ID NO: 106)

>3300013127|Ga0172365_10004082_5
[aquatic-freshwater-sediment]
MFGHTSDPSLIFRYGALPPVEDGPVLEQMRAAHRYRNKLVEIERDRREKAAAIVSAASPDLAGLERQYAELGEQVE
SAAAEIKATNQRARKQRATLEQRAKLRTLRAERAEVYARLKEAKHTAYHSLAARAALDQLDAVTLDATKAARATCS
VYWGTYLQIEAGLGSIRKGPPPRFLRWTGDGKLAVQIQGGMSRQEAEVGDSRLKIATLERRGKATNVYLRIGTDEM
RNPIWAIVPVIFHRPIPDDAQIKWVYLLARRVGTHTRWAVCFVLSRATGWGKPDLATDGAVGLDLGWRILDHGLRV
AYWCGSDGAGEEIVLPLRDVSRWQKADDLRAIRGKNFDAARDELALWLAGRDLPDWLIEQTRALRQWRNATRLAAL
AIHWREDRFTGDEEAFAPLEAWRTQDKHLLEWEANQRRKAVAWRDDFYRRVAADLSRRYKTLVIEDCNWREMGRLP
EVGESNESGRAGSYRVIAAVGSLARVLRERFAETVSADPAYTTQRCHVCGQLAQAETRTSVWVKCNHCGEAWDQDR
NAALNLLSAASGAVT (SEQ ID NO: 107)

>3300013127|Ga0172365_10004082_3
[aquatic-freshwater-sediment]
MIFRYGALPPVEDGPVLEQMRAAHRYRNKLVEIERDRREKAAAIVSAASPDLAGLERQYAELGEQVESAAAEIKAT
NQRARKQRATLEQRAKLRTLRAERAEVYARLKEAKHTAYHSLAARAALDQLDAVTLDATKAARATCSVYWGTYLQI
EAGLGSIRKGPPPRFLRWTGDGKLAVQIQGGMSRQEAEVGDSRLKIATLERRGKATNVYLRIGTDEMRNPIWAIVP
VIFHRPIPDDAQIKWVYLLARRVGTHTRWAVCFVLSRATGWGKPDLATDGAVGLDLGWRILDHGLRVAYWCGSDGA
GEEIVLPLRDVSRWQKADDLRAIRGKNFDAARDELALWLAGRDLPDWLIEQTRALRQWRNATRLAALAIHWREDRF
TGDEEAFAPLEAWRTQDKHLLEWEANQRRKAVAWRDDFYRRVAADLSRRYKTLVIEDCNWREMGRLPEVGESNESG
RAGSYRVIAAVGSLARVLRERFAETVSADPAYTTQRCHVCGQLAQAETRTSVWVKCNHCGEAWDQDRNAALNLLSA
ASGAVT (SEQ ID NO: 108)

>3300013127|Ga0172365_10033732_1
[aquatic-freshwater-sediment]
MAICKVYRYGLLPPTENRDLVLKTLRLAHEYRNKLVEIDRQERAEIRAVQTSHGSIPALAAAAKSAIQAKETAYQA
IKAHKAQDRTRKVPEPLKATYEAAKAAASAASQALWQARAALRGDPTVAIRRDEISLRYNEKRKAARAASGIYHGT
YMRVEAADQQARKMTPLWDGVEPSDVKFARWRGDGGVGLQMKEKPGPADLPTSRWCRIEPRGAPKGADPSSKRSAK
RRHCTLALRVGSEEREPVWARWPMVMHRPLPEDGEILWVTVTLRHVGPRQEWVALFTVRHEDKRQVPPAEPVDRVG
VDIGWRKLEGGGVRVAAWRTDSGAEGELVLDEHMLGQLRKADDLRSIRDKNLDAARASLVAAMPGMSLPDWFPKNV
WQWRAPARFSNLAKRWKQNRFPGDDLPYAQLEAWRYHDHHLWAWETSQRTKALRHRLDVYRVFAARMARTYTGLVI
EDWDMRDTAEKPDAHEQEGDNEQARSNRVKSAVSELRRALVQAFVNVAKVPAAYTTQTCSACGAIEKWDQAAELEH
TCSACGAQWDQDYNAARNLLAYVEQPGGPDNGGVARDEKKPNDGAEVQESKWAKAKRMGKEKRDRVDTARNTVPSA
AE (SEQ ID NO: 109)

>3300013128|Ga0172366_10016188_4
[aquatic-freshwater-sediment]
MFGHTSDPSLIFRYGALPPVEDGPVLEQMRAAHRYRNKLVEIERDRREKAAAIVSAASPDLAGLERQYAELGEQVE
SAAAEIKATNQRARKQRATLEQRAKLRTLRAERAEVYARLKEAKHTAYHSLAARAALDQLDAVTLDATKAARATCS
VYWGTYLQIEAGLGSIRKGPPPRFLRWTGDGKLAVQIQGGMSRQEAEVGDSRLKIATLERRGKATNVYLRIGTDEM
RNPIWAIVPVIFHRPIPDDAQIKWVYLLARRVGTHTRWAVCFVLSRATGWGKPDLATDGAVGLDLGWRILDHGLRV
AYWCGSDGAGEEIVLPLRDVSRWQKADDLRAIRGKNFDAARDELALWLAGRDLPDWLIEQTRALRQWRNATRLAAL
AIHWREDRFTGDEEAFAPLEAWRTQDKHLLEWEANQRRKAVAWRDDFYRRVAADLSRRYKTLVIEDCNWREMGRLP
EVGESNESGRAGSYRVIAAVGSLARVLRERFAETVSADPAYTTQRCHVCGQLAQAETRTSVWVKCNHCGEAWDQDR
NAALNLLSAASGAVT (SEQ ID NO: 107)

>3300013128|Ga0172366_10018111_5
[aquatic-freshwater-sediment]
MSGEEFLLDQLRARVDYWNRLVEIERDFQAEKEQLLSAASAEMEQLATYIALTDGKLTEALSAGARARSQARTRRT
PEPLAAEIAELRDRLRELRKQYREVRRTTFGNEKVKAALRTLGSERTAVIRKARREHVLKGLWWGNYLDVELAYKT
ARQKAGSRLRFQRTGPEGRVSVWFQHGLPTSDVWGKDSRLTIARVPEEAWTSDVRSVRRRLARTRVWLRAGSNPDR
SPRLIEAEMVMHRPLPHGLIRHASIIRERIASHYRHRLVITVAVQDIPTRDGREVGIDIGWRLFEDRLRVAVAVDE
ENQLEELSLPQEMLGGFAQVRDLQAVRDTHENGAKAMLAAFLHTAQMPDWLRDATSTLTQWRSQGRLTALALQWRD TABLE 2-continued Amino Acid Sequences of Representative CLUST.018837 Effector Proteins*

RRFKDDAVYAMLEAWRKRDKHLWEWQANLRDKLLARRREMYRLWAISIARRYGTVVIEEFDLRRIVSEDNIDVADR
MRFIAALSQLRSILEHTCAREGVRIVKVPASYTTQDCAFCANREQFDARKEVRHRCSKCGAEWDQDENAARNLLKR
AKGSQVSRKEV (SEQ ID NO: 110)

>3300013129|Ga0172364_10001281_26
[aquatic-freshwater-sediment]
MAVEAQFRAAQWYRNRLIEITNKSREKYQQLMLRIPEIARLQETIDADKALKESLREEIKVASAKARKNVPLRPGL
REQIASLTKAIKENALTLRAAKDKAKAQIAEETNALYAETAAEQKALYNEAGQPGEIVHRKEGHPDIREPRVPLAW
GTRLLMNKAHEQACSTGMPLKVRHDPVGRIGVQLQKGRTISQIFSGKDGFLRIEPVPDDTWDPRPQNAPKKGERLT
REQHKARKGTGGKTKSRTRVHLNIGEGRGEDRPFATFPITLYNRKLPVDGKVLWAWILRERIGTRMEYKLQLSVES
NTFKCESDGHGAIAFDIGWRVRSKNNLRIAYWFDDYGQSGEILLPEIIPSGLAKADSLQAIRKRKFNRMRALLSKA
KADAIKTGMAIPPALLTETETLSAWRSEDRLRRLVKHIWPNHRFAGDERWFNIAKNWLHKELHLYQWECDERQQAI
ARRTNEYRHTALEFARKYQTCVFENFKLTRIAVKEPVESEKADTPSNIQHNRVVSALSDERDAFKNKMIFAKVPME
FTTIVCHNCRHPEKFNAAKELIRTCPKCNTTWDQDLNAAKNILSRFHCEGTSGTDMGVQAA (SEQ ID NO: 111)

>3300013129|Ga0172364_10017363_4
[aquatic-freshwater-sediment]
MFGHTSDPSLIFRYGALPPVEDGPVLEQMRAAHRYRNKLVEIERDRREKAAAIVSAASPDLAGLERQYAELGEQVE
SAAAEIKATNQRARKQRATLEQRAKLRTLRAERAEVYARLKEAKHTAYHSLAARAALDQLDAVTLDATKAARATCS
VYWGTYLQIEAGLGSIRKGPPPRFLRWTGDGKLAVQIQGGMSRQEAEVGDSRLKIATLERRGKATNVYLRIGTDEM
RNPIWAIVPVIEHRPIPDDAQIKWVYLLARRVGTHTRWAVCFVLSRATGWGKPDLATDGAVGLDLGWRILDHGLRV
AYWCGSDGAGEEIVLPLRDVSRWQKADDLRAIRGKNFDAARDELALWLAGRDLPDWLIEQTRALRQWRNATRLAAL
AIHWREDRFTGDEEAFAPLEAWRTQDKHLLEWEANQRRKAVAWRDDFYRRVAADLSRRYKTLVIEDCNWREMGRLP
EVGESNESGRAGSYRVIAAVGSLARVLRERFAETVSADPAYTTQRCHVCGQLAQAETRTSVWVKCNHCGEAWDQDR
NAALNLLSAASGAVT (SEQ ID NO: 107)

>3300013129|Ga0172364_10018773_2
[aquatic-freshwater-sediment]
MSGEEFLLDQLRARVDYWNRLVEIERDFQAEKEQLLSAASAEMEQLATYIALTDGKLTEALSAGARARSQARTRRT
PEPLAAEIAELRDRLRELRKQYREVRRTTEGNEKVKAALRTLGSERTAVIRKARREHVLKGLWWGNYLDVELAYKT
ARQKAGSRLRFQRTGPEGRVSVWFQHGLPTSDVWGKDSRLTIARVPEEAWTSDVRSVRRRLARTRVWLRAGSNPDR
SPRLIEAEMVMHRPLPHGLIRHASIIRERIASHYRHRLVITVAVQDIPTRDGREVGIDIGWRLFEDRLRVAVAVDE
ENRLEELSLPQEMLGGFAQVRDLQAVRDTHENGAKAMLAAFLHTAQMPDWLRDATSTLTQWRSQGRLTALALQWRD
RREKDDAVYAMLEAWRKRDKHLWEWQANLRDKLLARRREMYRLWAISIARRYGTVVIEEFDLRRIVSEDNIDVADR
MRFIAALSQLRSILEHTCAREGVRIVKVPASYTTQDCAFCANREQFDARKEVRHRCSKCGAEWDQDENAARNLLKR
AKGSQVSRKEV (SEQ ID NO: 112)

>3300013129|Ga0172364_10045136_2
[aquatic-freshwater-sediment]
MAICKVYRYGLLPPTENRDLVLKTLRLAHEYRNKLVEIDRQERAEIRAVQTSHGSIPALAAAAKSAIQAKETAYQA
IKAHKAQDRTRKVPEPLKATYEAAKAAASAASQALWQARAALRGDPTVAIRRDEISLRYNEKRKAARAASGIYHGT
YMRVEAADQQARKMTPLWDGVEPSDVKFARWRGDGGVGLQMKEKPGPADLPTSRWCRIEPRGAPKGADPSSKRSAK
RRHCTLALRVGSEEREPVWARWPMVMHRPLPEDGEILWVTVTLRHVGPRQEWVALFTVRHEDKRQVPPAEPVDRVG
VDIGWRKLEGGGVRVAAWRTDSGAEGELVLDEHTLGQLRKADDLRSIRDKNLEAARAALVAAMPGMSLPNWFPKNV
WQWRAQARFSNLAKRWKQNRFPGDDLPYAQLEAWRYHDHHLWAWETSQRTKALRHRLDVYRVFAARMARTYTGLVI
EDWDMRDTAEKPDAHEQEGDNEQARSNRVKSAVSELRRALVQAFVNVAKVPAAYTTQTCSACGAIEKWDQAAELEH
TCSACGAQWDQDYNAARNLLAYVEQPGGPDNGGVARDEKKPNDGAEVQESKWAKAKRMGKEKRDRVDTARNTVPSA
AE (SEQ ID NO: 113)

>3300013130|Ga0172363_10000480_22
[aquatic-freshwater-sediment]
MAVEAQFRAAQWYRNRLIEITNKSREKYQQLMLRIPEIARLQETIDADKALKESLREEIKVASAKARKNVPLRPGL
REQIASLTKAIKENALTLRAAKDKAKAQIAEETNALYAETAAEQKALYNEAGQPGEIVHRKEGHPDIREPRVPLAW
GTRLLMNKAHEQACSTGMPLKVRHDPVGRIGVQLQKGRTISQIFSGKDGFLRIEPVPDDTWDPRPQNAPKKGERLT
REQHKARKGTGGKTKSRTRVHLNIGEGRGEDRPFATFPITLYNRKLPVDGKVLWAWILRERIGTRMEYKLQLSVES
NTEKCESDGHGAIAFDIGWRVRSKNNLRIAYWFDDYGQSGEILLPEIIPSGLAKADSLQAIRKRKENRMRALLSKA
KADAIKTGMAIPPALLTETETLSAWRSEDRLRRLVKHIWPNHRFAGDERWENIAKNWLHKELHLYQWECDERQQAI
ARRTNEYRHTALEFARKYQTCVFENFKLTRIAVKEPVESEKADTPSNIQHNRVVSALSDERDAFKNKMIFAKVPME
FTTIVCHNCRHPEKENAAKELIRTCPKCNTTWDQDLNAAKNILSRFHCEGTSGTDMGVQAA (SEQ ID NO: 111)

>3300013130|Ga0172363_10009486_8
[aquatic-freshwater-sediment]
MFGHTSDPSLIFRYGALPPVEDGPVLEQMRAAHRYRNKLVEIERDRREKAAAIVSAASPDLAGLERQYAELGEQVE
SAAAEIKATNQRARKQRATLEQRAKLRTLRAERAEVYARLKEAKHTVYHSLAARAALDQLDAVTLDATKAARATCS
VYWGTYLQIEAGLGSIRKGPPPRFLRWTGDGKLAVQIQGGMSRQEAEVGDSRLKIATLERRGKATNVYLRIGTDEM
RNPIWAIVPVIEHRPIPDDAQIKWVYLLARRVGTHTRWAVCFVLSRATGWGKPDLATDGAVGLDLGWRILDHGLRV
AYWCGSDGAGEEIVLPLRDVSRWQKADDLRAIRGKNFDAARDELALWLAGRDLPDWLIEQTRALRQWRNATRLAAL
AIHWREDRFTGDEEAFAPLEAWRTQDKHLLEWEANQRRKAVAWRDDFYRRVAADLSRRYKTLVIEDCNWREMGRLP
EVGESNESGRAGSYRVIAAVGSLARVLRERFAETVSADPAYTTQRCHVCGQLAQAETRTSVWVKCNHCGEAWDQDR
NAALNLLSAASGAVT (SEQ ID NO: 114)

>3300013130|Ga0172363_10014785_2
[aquatic-freshwater-sediment]
MPRTRSKALPTKVYKYGCSAPLENQELVKEQWRLANRYRNALLENSLQWRSACQAVVSAEDTELRDIDTCIDILNV
NIDSLISEKKKRNSAARKRLKHPDLEAKITDCKTERKRLYARRKLVKDIAYRSPGNKQALDAVHQAFKAANREARK
IASKSGLGWGTYLQIEDSAKNFAKGKPAKFKRFDRDAGGSIAIQIQTPQGAPHLTVDRLLEGKDNRLQLIPQPDGI
HALVRLCVGGVDMSQRRSANNPPCYVTVRMNMHRPLPPDSHITWVKLIARRVGLKLKWDVHFTVARGSGFAPTIGS
GVVGIDIGYRHLDDGSLRVAAWAGSDGRHGELILPATLVRALTRKQELQALRDEKENVVRASLVEWCKHVSIPDWL TABLE 2-continued Amino Acid Sequences of Representative CLUST.018837 Effector Proteins*

KEAASTLALWRSQKRLHTLAQQWSQNRFTGDSSMYIVLDAWRKEDRHHLAWLANESEQGICRRKDIYGKEVAELRR
HYGTVGLEDIDLREHAQADNLSKGVQNQRSIAAHSTLRSLLSTMQVIKVPAANTTRRCHYCGHINNVGTDVGYYCD
DCGWTGDRDYNASQNILREATYSLRAGGRSHVAT (SEQ ID NO: 115)

>3300013133|Ga0172362_10012573_3
[aquatic-freshwater-sediment]
MFGHTSDPSLIFRYGALPPVEDGPVLEQMRAAHRYRNKLVEIERDRREKAAAIVSAASPDLAGLERQYAELGEQVE
SAAAEIKATNQRARKQRATLEQRAKLRTLRAERAEVYARLKEAKHTAYHSLAARAALDQLDAVTLDATKAARATCS
VYWGTYLQIEAGLGSIRKGPPPRFLRWTGDGKLAVQIQGGMSRQEAEVGDSRLKIATLERRGKATNVYLRIGTDEM
RNPIWAIVPVIEHRPIPDDAQIKWVYLLARRVGTHTRWAVCFVLSRATGWGKPDLATDGAVGLDLGWRILDHGLRV
AYWCGSDGAGEEIVLPLRDVSRWQKADDLRAIRGKNFDAARDELALWLAGRDLPDWLIEQTRALRQWRNATRLAAL
AIHWREDRFTGDEEAFAPLEAWRTQDKHLLEWEANQRRKAVAWRDDFYRRVAADLSRRYKTLVIEDCNWREMGRLP
EVGESNESGRAGSYRVIAAVGSLARVLRERFAETVSADPAYTTQRCHVCGQLAQAETRTSVWVKCNHCGEAWDQDR
NAALNLLSAASGAVT (SEQ ID NO: 107)

>3300013133|Ga0172362_10022806_8
[aquatic-freshwater-sediment]
MPRTRSKALPTKVYKYGCSAPLENQELVKEQWRLANYRNALLENSLQWRSACQAVVSAEDTELRDIDTCIDILNV
NIDSLISEKKKRNSAARKRLKHPDLEAKITDCKTERKRLYARRLVKDIAYRSPGNKQALDAVHQAFKAANREARK
IASKSGLGWGTYLQIEDSAKNFAKGKPAKFKRFDRDAGGSIAIQIQTPQGAPHLTVDRLLEGKDNRLQLIPQPDGI
HALVRLCVGGVDMSQRRSANNPPCYVTVRMNMHRPLPPDSHITWVKLIARRVGLKLKWDVHFTVARGSGFAPTIGS
GVVGIDIGYRHLDDGSLRVAAWAGSDGRHGELILPATLVRALTRKQELQALRDEKENVVRASLVEWCKHVSIPDWL
KEAASTLALWRSQKRLHTLAQQWSQNRFTGDSSMYIVLDAWRKEDRHHLAWLANESEQGICRRKDIYGKEVAELRR
HYGTVGLEDIDLREHAQADNLSKGVQNQRSIAAHSTLRSLLSTMQVIKVPAANTTRRCHYCGHINNVGTDVGYYCD
DCGWTGDRDYNASQNILREATYSLRAGGRSHVAT (SEQ ID NO: 115)

>3300013133|Ga0172362_10025871_2
[aquatic-freshwater-sediment]
MAICKVYRYGLLPPTENRDLVLKTLRLAHEYRNKLVEIDRQERAEIRAVQTSHGSIPALAAAAKSAIQAKETAYQA
IKAHKAQDRTRKVPEPLKATYEAAKAAASAASQALWQARAALRGDPTVAIRRDEISLRYNEKRKAARAASGIYHGT
YMRVEAADQQARKMTPLWDGVEPSDVKFARWRGDGGVGLQMKEKPGPADLPTSRWCRIEPRGAPKGADPSSKRSAK
RRHCTLALRVGSEEREPVWARWPMVMHRPLPEDGEILWVTVTLRHVGPRQEWVALFTVRHEDKRQVPPAEPVDRVG
VDIGWRKLEGGGVRVAAWRTDSGAEGELVLDEHTLGQLRKADDLRSIRDKNLEAARAALVAAMPGMSLPNWFPKNV
WQWRAQARFSNLAKRWKQNRFPGDDLPYAQLEAWRYHDHHLWAWETSQRTKALRHRLDVYRVFAARMARTYTGLVI
EDWDMRDTAEKPDAHEQEGDNEQARSNRVKSAVSELRRALVQAFVNVAKVPAAYTTQTCSACGAIEKWDQAAELEH
TCSACGAQWDQDYNAARNLLAYVEQPGGPDNGGVARDEKKPNDGAEVQESKWAKAKRMGKEKRDRVDTARNTVPSA
AE (SEQ ID NO: 113)

>3300010155|Ga0098047_10009758_2
[aquatic-marine]
MPVKSKMKGDGRIYAYRASLPTKNLEIVQEQLYLVHKYRNRLVELELNRRSQVDQALRDLVPDLEPTELALKQLDD
QIAAAKDAQKKANIKQRGRKVAKSDRDALKDLKAQRKVLYQKRKQLRKDTESSTAWKSRQTQIENNAKVESKAARA
SCGLYWGSYAPVEEAARAFRRGAPPREHRWTGEGKLAVQMQAQAGKPDFTPDTLTSCSSNLLRLELRPEGIWVDGK
RRPKKLGNALLWERVGSTTVKPKRQPIWAEVPIKLHRPLPSDCIKWCYLQRRKRGTKTIWEVCFVLQGEHGAFDP
GDQASEGHVGIDVGWRKYEDRLRIAVYSGSDGQEGELCLPDWWLGESRRVERIRGHRDKLLDAAKTELKAWIKGRE
SLPDWLTEAGKHMHQWRSASRLAGLCLRWRGELIKPTTDGAAALASLEAWRERDKHLYEYEAHLRAQLQGSRKDLY
RKFAAMLSRKYATAYIEDLDLRKFHQLRAIEEGGDKGTDSIRAYVRDACLSELFDAIKSRFRHHVKVDPANTTKQC
HACSVVDASWVDHAKVDHECSSCSVTWDQDTNAARNLLNSGDEPVTQFGGPALAPVLVHTYTHKGPNRARRRARRR
RALEKKRLNDAA (SEQ ID NO: 116)

>3300006805|Ga0075464_10026824_2
[aquatic-marine-aqueous]
MRVYKYRAYAPIVGAGIFDAQSRARHRYQNQLIEIERAWCGLDRATKKDPEAQARRKALVKAARQDAARRGLAWGS
YNGASDDVRRAVSALRGAARDEGPRFRREDGGGRIKVQQQPGARVVVIDGDRVTFRLGHQGAVTVPVVMHRPIPPD
ATIKEAQLHRERVADKYKWWVTITVAVPAPPPAPPRGVVGIDLGWARRGGKSERDGRRVAVASFADGRELQVRCPE
SILAKIDHARGLRSLRDVKFNVAIAWLREHVCEHGAPEWLRAALRWSHAWRSQAKLAAVVLRWRDARYDGDDGIYQ
TLEIWRRRDKHLWTWEVHETRKALAQRREIYRVAAAYIAEHAGEVRVEDIDLAEMAESDDLPRAARRGRVDTAPST
FLAAVKNACSSRGVTYAVVSAKNTTRKCSGCGVVGRSVVGDTFACGGCGLVADRDANAARNIAASAPEAPREPKPK
SADLRRAGKARHDAARAAAVKAA (SEQ ID NO: 117)

>3300006805|Ga0075464_10026824_2
[aquatic-marine-aqueous]
MDVRVYKYRAYAPIVGAGIFDAQSRARHRYQNQLIEIERAWCGLDRATKKDPEAQARRKALVKAARQDAARRGLAW
GSYNGASDDVRRAVSALRGAARDEGPRFRREDGGGRIKVQQQPGARVVVIDGDRVTFRLGHQGAVTVPVVMHRPIP
PDATIKEAQLHRERVADKYKWWVTITVAVPAPPPAPPRGVVGIDLGWARRGGKSERDGRRVAVASFADGRELQVRC
PESILAKIDHARGLRSLRDVKFNVAIAWLREHVCEHGAPEWLRAALRWSHAWRSQAKLAAVVLRWRDARYDGDDGI
YQTLEIWRRRDKHLWTWEVHETRKALAQRREIYRVAAAYIAEHAGEVRVEDIDLAEMAESDDLPRAARRGRVDTAP
STFLAAVKNACSSRGVTYAVVSAKNTTRKCSGCGVVGRSVVGDTFACGGCGLVADRDANAARNIAASAPEAPREPK
PKSADLRRAGKARHDAARAAAVKAA (SEQ ID NO: 118)

>3300009149|Ga0114918_10020022_2
[aquatic-marine-deep subsurface]
MGGKAGTVKTAKKHKHRWVEDLEKDLIENCSCGKSRKSQNSSVIVYGLGKPMFDEEGSECPSCNEESNGEPCGAHR
FIDQMRLGHSYGNKLTELYRASSERYREIIGSASKKMEVIVMKLDDLDDQIKGLNALLKADKDNKEAKKLKKELTA
DRKIIRADRKELVEKLKQNKIIQARLKKNNIKLNSEIIKARGEFSKLGLMWGTYNLHEASAKQAYYAPGRRGDPEF
KRWEGHGRIGVQLQGGLPESKVWGDSRSFQIDKVDHETWSKLREDGSPDRAFRRKQCRTKVRVRIGSAKAKPIWVE
FPMTMHRPIPEGADIRDVTILQKKSGTIYRYSLHVQINENKTNQPERSGVVGVNLGWRKHQDNTLRVAYWYGDDGR
YGEYLLDSEYLEKVKVMDGKQSKRSMALDVIKETFAVWLDGQDNLPEWIQEWRGIKFIRDWRSSSRLASLVLRWRK TABLE 2-continued Amino Acid Sequences of Representative CLUST.018837 Effector Proteins*

NRFDGDALIFENLEEWRRADKHTCNQEGGIRNKNQLRRQDEYRNFAAFLARTYGKVVVDDTNYANLARKPGPEDDD
NKVARKQANLASPGKLRVNIKNACHKHGAIYVAASSKHITATCHKCGTINDWDKSLSLTHWCSGCNAFWDQDMNAA
INLCRSGGGKPPNFEHPGDARIELNDEVNKYDWLIQESAGMAGSKKQPIENLAVTL (SEQ ID NO: 119)

>3300006083|Ga0081762_1007854_6
[aquatic-marine-diffuse hydrothermal flow volcanic vent]
MRERARNWPVMVFSYGILPSFLKEEAAINILKEEAYRMNELWNKLVEIGRKYLETYSSNIEEDPAIAPLISQRKEI
ENTLEETDKQIKQLRIKLKTKKHPALAELEEKKRELRRQLREIKASIRETKKQVKEKYREVFAQMEEEVKEAVKKA
PLYWCNKEVVRDKFWAAWRGVKNGNIPKEHRFDDRWCLTWRFTGGGMPVKDAFRKVLSGIVPPEVYKLPTKKRNKM
ANLTCLFRQGEYRILVPIILHRPLPEGGYIKRVTFVRRPYGRDRVRLFLNFTVEVPPDKYYLPVREERKGKIAALE
LGFRKVDGRIRVGVLYDPFTEEKFREIFIPQNIPERLEKVRKGQSKADEELEDIKNDLSKWLVEPQVLPKLPEEIK
KLITNRVAWVKTRDRGVWKVINLLKESGADPAAARNVERRMLKREKFLNDLQRTRIKALGARKRFYENLAKEIFDR
YEMLIIKDISLKKLALKEMAEQLPDEARWVREVAALGELVGCLERRAERTKGVLVKLDPAYLTRTCHICNHINNPN
RPEKLFWTCEKCGTKWDQDKNAAVNLYEQGIERLKLAQTG (SEQ ID NO: 120)

>3300010354|Ga0129333_10000304_8
[aquatic-marine-freshwater to marine saline gradient]
MRLGHRYQNDLIAIERGRRLAFAAVMSSDTRIAEAEAKITEIDAKISEAVERARQARVARRTKADTEQTKSEIRSL
KASKAAAVLDLRAIKPLVQSELRPRIAEVDARAHELQISARAHCGVYWGTYLLAEAAAEQAAKTTKGELRFQRWDG
SGQVSVQIQGGADVDDVVGDSDTRLRWPEYVEGTRKAKRTELAMRVSSEKGVPVWARWPMVYHRPLPTNARIKRAI
VSLRMRGPREEWSVEVTIDASTCRLRDRPDGGKVAVHLGWRKEPSGNVRVATWLGDDGDAGTIECPERVLTGFAKC
ESLRSIRDRNLDELRARLVLAREGWPVWLRDATSSLYQWRSPGREVALAQRWKAAGVAPEHASDYGAIEAWRYNDH
HLWRWEHDQRLNSTRYRREVYRIAVAELSRRYRRAILMAADWAEMAKLPGIGEGAPDLPDEARAQRVETAPYVLTE
ALHSAMTEVVWVDPSYLSQACRHCDHKDTGDTWVRECTSCGKARDIDEAAVRTMLDLEEAGAWSWKKGGAKDESGK
VREIRAPKWAKKHATEAAE (SEQ ID NO: 121)

>3300010354|Ga0129333_10000304_10
[aquatic-marine-freshwater to marine saline gradient]
MTTRVYRYGLLAPTENSELVRQQMRLGHRYQNDLIAIERGRRLAFAAVMSSDTRIAEAEAKITEIDAKISEAVERA
RQARVARRTKADTEQTKSEIRSLKASKAAAVLDLRAIKPLVQSELRPRIAEVDARAHELQISARAHCGVYWGTYLL
AEAAAEQAAKTTKGELRFQRWDGSGQVSVQIQGGADVDDVVGDSDTRLRWPEYVEGTRKAKRTELAMRVSSEKGVP
VWARWPMVYHRPLPTNARIKRAIVSLRMRGPREEWSVEVTIDASTCRLRDRPDGGKVAVHLGWRKEPSGNVRVATW
LGDDGDAGTIECPERVLTGFAKCESLRSIRDRNLDELRARLVLAREGWPVWLRDATSSLYQWRSPGREVALAQRWK
AAGVAPEHASDYGAIEAWRYNDHHLWRWEHDQRLNSTRYRREVYRIAVAELSRRYRRAILMAADWAEMAKLPGIGE
GAPDLPDEARAQRVETAPYVLTEALHSAMTEVVWVDPSYLSQACRHCDHKDTGDTWVRECTSCGKARDIDEAAVRT
MLDLEEAGAWSWKKGGAKDESGKVREIRAPKWAKKHATEAAE (SEQ ID NO: 122)

>3300009507|Ga0115572_10029017_2
[aquatic-marine-pelagic marine]
MISRVYKYGAVPLKKEPEVKFPREQFPEEGVEELRRANKLRNSLVWLHRKNNEKFEAARVAADAEYGEIAEKLDAL
EKTISQALTAKRQARAKAGTRDAKHPLVKAASETINELTKQRSDLWKALKPARIRADKRVDRKALTKQEDDAVKVV
QHVKETGGLSSHCANEIVRYFKESRSRALNERATLRYRREDGTGEWFYRFREPGVNKNGVDEDGLLTGNKTEARDN
RNEVLTEKSRRGKRVIYKLRAKIAGGAKKDSKVYGHFDLILHRPIPENARIQSAKILRHRTGDKFTYTVSFTLKLP
DVEQQTVEGSVLGLDIGFREMERNNSYRIATLATNDQSRRVETIDIARENRRGFLARMNHIDDLRSTMDENATELG
KKLLPLLKTAKPLPDSHQQFIFTERLRKTRANVTLDFERSYKMARWFIRAPDEADFYGPEIVGMVLRWWEENSFKY
REMHNLRRKALAERKEVYRMEAARLVGEGIPIAVEKLDMSKWAERKDSDNELSNRALSSRFLVAPSELIAAIENAA
KREGVPFIKVNAANTSKACHACGTINKALKGELIWTCEECETKHDRDINAAINIAKRGILQAKKEKKQ (SEQ ID NO: 123)

>3300017963|Ga0180437_10000100_151
[aquatic-non marine saline and alkaline-hypersaline lake sediment]
MTKTYVYGLPLPGPTVNADLVEEQMRLAHKYRNALIEIERERREKVREVYDERDLALEGLVEEDKVAKSELKRATED
LKRQRAKTRSRSDTAEQRARVKEARKAAQEVAKRLSEARKELKLDEELQKRLSEANLTASEKSQAAQQGFSREGLF
WGTYLQVDNAMEDSRRDLKMWDEHGQPLDPKFLQWRGDGTVAVQLQGDKHPVEKIFSGEDTFLQVDMEPPPEGVVS
KTRRKKRRGVMRLRVGSTKSRGPVWAEFPIIMHRPLPQGVRIKWAVVKRRMISDRPRWTVHFSLGLPAEYQHEEFG
SGRGAVAVDIGWRKRGEDQIRVAYLVDGDEYAAYLRDRQDPLGRDELLMEPEVVRGDRKVESLQSIRALNQNEMQ
KSLKGWIKSNKKNLPEWFREDVRYLHSWKSPKRYAGLLRKWGEKRWDGDEGFQILKDWLSGTYEESLGRRDGGDR
HLWQWKESQEQKSLRRRKDHYRRVAAKLARKYKVLVIEDFKLTETQKHEPPESEKVEIQAARNQQKEAACYELRMM
FVQAFLARGGTVVWVDARMTTQRCFECGCLEPWDAIPEVDHVCVECGAKWDQDANAARNIMRLYRNDETLKMIDGS
VPVEPKMSRRQKGRKKGKKIVQQRKSQEAAQPSV (SEQ ID NO: 124)

>3300017963|Ga0180437_10000153_25
[aquatic-non marine saline and alkaline-hypersaline lake sediment]
MTRKTSKTKRKKKPGKPRVRGPQLAYVYGLPFGPTKNAELVEKQIVLSQRYNNQCVEAERRLRATLREIYQQHTLD
LMGASDEMREAFTEVKRLEKLLREMQEDLRTKRKRSRSRSDTPQEMRHLREVRDLKNEAWAKLRELKNGSEGDDEP
GKEEPRKKVELSDELKARRAEAQQREKQELHEAYVQFKDGTYEKVTETDEELGKLYWGTYLLVNRAREEASRMSLRD
SLWKWNEEKGIWVERDPKEKSLDDEVIEGVELQKGDSVERVLNCQNTMFQLDMEPEMGEEVLRHRRIRRRGIARIR
VGSGGKSGRDPIWAEFPVIMHRPLPPKARIKWAVVKREKITTRLRWTLHLHLEVDSGDCHKDYGTGRGVVAVDIGW
RKRGTETVEMGRKRKRKGLRKQEVEVPRIRIAYLIDDREYAAYLKNPDEGEVGHEQCMSSKVVAGFQRVETLQQTR
QLKQNEMLAELRAWIKARRSALPKWFRESTRGIAKWEAPKRFAWLLRLWRESRWKGDERGFEILDRWQRGVYDEEA
RRLEGGDRHLWQWQESQRRKSLLQREDHYRCVDSALAREFKVLVLENIDLSKMQKHELPGSDKVEIRRARRQQKEA
ALSEFRETLIQAFLSRGGTVVWVNPAMTTQRCEDCGHDAPWDPIPKVEHTCEKCGRTWDQDANAARNMMRLYRENK
IVKIADGSVLVREMSDAQKNRNKGKKVVRKRKKEEEERNGEGPAPLES (SEQ ID NO: 125)

>3300017963|Ga0180437_10000488_78
[aquatic-non marine saline and alkaline-hypersaline lake sediment]
MRVYKYGLLRPTTNADLVHEQIKIGHKYRNKLIELEIKRRDLIRAEVAKSSVVEDDFTDAKLAVEKEKHLDKLLKQ
KNAQHRSKRHNNPDLKKDHTKARKEKTKAIKKLEETRRKVLKKCKETIKVENDQYIEEEKKVRSECAPFWGTYQVI TABLE 2-continued Amino Acid Sequences of Representative CLUST.018837 Effector Proteins*

EDAMKRSRKSLPLWDGLESNNPKERRENGIGRVSIQLQKDVIDKNNGMNVDLVEGTTDTRLQVAPVPEEAWYSPIR
SVRRKKSRTVLKMRIGSEGRAPIWAEWPMIMHRPLPDNGRIKRVTVNERKIGPREEWTADFFINDSATLHEQYEVS
GAIGLDVGWRLMDDGSLRVAFWEDDEGEKGEFRLSPTLMGAFKKADDLRSIRDKNRDEIKEFLIQHFSKNPMPSWM
LDFVKGKEDSKRPTNKQACVYLSKWKSIAKLTKLVQTWKEKGITKRHQKAYNRFEDWRYHDFHLWQWETSQRKKAE
RRRKDNYRVLASKLSKQYHTLVLENFDLRKVARKKAADDDSLDIKAANHNREVANISELRLVLRNAFEKCGEIELV
KAVNTTKICFWCGFINNFDQAKNLIHQCYSCGVVWDQDDNASTNIRRRRKQG (SEQ ID NO: 126)

>3300017963|Ga0180437_10000692_13
[aquatic-non marine saline and alkaline-hypersaline lake sediment]
MGAARRRNPKVAAARKGKPPPKATGNCRNYRYGAHEPIANLDKVLDEMRGAHDLRNVLTCINRARSEMITAALGEH
QSYKKATADLAALHQRRDKLEAQIRQQNSASRKRLGRHSPLSSELDTVRKRIDEGRTALKKLRRKLLKKDPALKAV
VEAADDMAKRETTRAEDACGLYWCTRNEQTGKRAKLRRFKKWRDSEATISVQIPGGLTVEQLLGGENNQARLELRP
EGVWVQGARKRKVEPAEAARNKLRLDEDGYPMRKLGTAILHLRCMSDEDGKPIWAEVPITYHREIPADAKIKRCYL
HRFRVGNRYHWSVRFSLERGKKGDDSWLHPRVATTGTAAIDIGWRWFPDRLRVAVWAGSDGAEGELCLPKWWLDEM
YSVRLDQRERDVLFNEIVSLVLPWERSRRGELSDYVVQAIKTMHSWRDKGRLAALSMRWRDDLAADPGANPAHVAM
SIRLEEWRKRDKHIWCEEVNLRSQLQGSRKDLYRRFAAMLTSRYGRIVVEEFDLSAVQKLPPASIDDGTYSRVKRH
KGDAACSHLVGALKDAARQLDKKNPKWTTKRCHVCGKTERKWENPGELEHTCKHCGVLWDRDVNAARNILAASGVA
VDWTRPPLAPAARMTYPQVENREMRRSRRRKEALETTRASGDRQTA (SEQ ID NO: 127)

>3300017963|Ga0180437_10006965_20
[aquatic-non marine saline and alkaline-hypersaline lake sediment]
MLKRGERGERGERGERGERGERGASMPRNPKKKMDGVGRNYKYGAYAPLTNEDEVRWQMVLGHRYRNRLVEVELDI
RAKRDAIIQEVAPGLLLALEDEINKMGEIIALHEKAQKEQNKKQRGRDVHPGVANLLRDLKAEKKGLVGKRKALKAE
LFASDRWKQDGGDHLNQQRKEGRSNAYSEYKDEGLWWGVRSKILRESGSFISGAPPKERGWHKSVRSTREVVQTQG
GLTEEELLSGRNTTARLTLFPDGVWAEGKRRPKRMGDAILDLRIGSDEHRKPIWTSIPISYDRHLPAEAKIKWIYL
FKRLLVDKEKWEVVFALECPAAADYDAIRRRGGDKKRTNRNRKGIRLRKYAQSGVVAIDVGWRKFEDYLLVGTCAA
SDGREWELRLDGNWLGQLRRVEGMQSYRDVLLNEQVKWLHPWLKSRKGSLPELLLPPSRNLEKWGQRSVARLVKQW
MRERPIGTLDEQRALARLDEWLSRENHVWHFQANLQHQLLLYRREEYRVWARRIGEVYRCVVLEKLNYGDWHKKPP
VERGGSVKADMAKKYLRDAGLSHLKNALKGGVLQVADVPHEGTTVNCHACGHADVWEDPAAKDHVCETCGLRWDRD
VNAARNILAASGVTVAWEREPLAPTEAWTACSKSGLNRAQRRAISSSLAIDSEIALAVGGSE (SEQ ID NO: 128)

>3300017963|Ga0180437_10006965_20
[aquatic-non marine saline and alkaline-hypersaline lake sediment]
MPRNPKKKMDGVGRNYKYGAYAPLTNEDEVRWQMVLGHRYRNRLVEVELDIRAKRDAIIQEVAPGLLALEDEINKM
GEIIALHEKAQKEQNKKQRGRDVHPGVANLLRDLKAEKKGLVGKRKALKAELFASDRWKQDGGDHLNQQRKEGRSN
AYSEYKDEGLWWGVRSKILRESGSFISGAPPKERGWHKSVRSTREVVQTQGGLTEEELLSGRNTTARLTLFPDGVW
AEGKRRPKRMGDAILDLRIGSDEHRKPIWTSIPISYDRHLPAEAKIKWIYLFKRLLVDKEKWEVVFALECPAAADY
DAIRRRGGDKKRTNRNRKGIRLRKYAQSGVVAIDVGWRKFEDYLLVGTCAASDGREWELRLDGNWLGQLRRVEGMQ
SYRDVLLNEQVKWLHPWLKSRKGSLPELLLPPSRNLEKWGQRSVARLVKQWMRERPIGTLDEQRALARLDEWLSRE
NHVWHFQANLQHQLLLYRREEYRVWARRIGEVYRCVVLEKLNYGDWHKKPPVERGGSVKADMAKKYLRDAGLSHLK
NALKGGVLQVADVPHEGTTVNCHACGHADVWEDPAAKDHVCETCGLRWDRDVNAARNILAASGVTVAWEREPLAPT
EAWTACSKSGLNRAQRRAISSSLAIDSEIALAVGGSE (SEQ ID NO: 129)

>3300017963|Ga0180437_10073069_2
[aquatic-non marine saline and alkaline-hypersaline lake sediment]
MGMVPLLEQQTKEAGERVSEASKSVKQYRSKNRTRKVPEWMRTELDAARLAKKDVAAKLREVRKQLRTPEIQAEMD
RINGLAGELRRSARAHCGLYWGSYLLVEDEMASSSKSPLYDKENPNEPNDPGFVRWHGEGHLGVQIQGGMPTGLVQ
FHSTLLQIKKVDPVEGKLGKSHYLLRMRVGSNGRKPIWGEWPMVMHRPLDPGQIKGAAVSCRRIGLRWQWTVEITV
DKESGCRPRPCGYGQVAVNEGWRKVDGGIRVAYAVDYEGNEQELVLPDGEAEGIVRPSRVRERLTDEQRAIQKRDG
IIYGKACRLSDDGKSYEAEKVLSGRPDLLSRLSSRVRPARKPPILPALRKSDELRSIRDQRFGHILQSLIKWLKTI
EVPCWLKDRTSHIHKWKSQNRLRKLIGYWRSNREDGDETMEQSLEVWNHRDEHLLSWEDSQRKKSQRRRRDLYRVW
AAKLADRYYTIVLNSHDMAETARKPKVEATDDIPLSRSNRQLVSPSELKEALINAKRSREGQTVENPAQKVTHTCH
NCETEQDFDAASSIEHTCLACGETWDQDRNAAINSLRWFVERPSDAKILGTARKIKNLDENGVEKETRRQRISRLK
REKDARMKALANDAASS (SEQ ID NO: 130)

>3300017971|Ga0180438_10000090_91
[aquatic-non marine saline and alkaline-hypersaline lake sediment]
MTRKTSKTKRKKPGKPRVRGPQLAYVYGLPFGPTKNAELVEKQIVLSQRYNNQCVEAERRLRATLREIYQQHTLD
LMGASDEMREAFTEVKRLEKLLREMQEDLRTKRKRSRSDTPQERMRLREVRDLKNEAWAKLRELKNGSESDDEP
GKEEPRKKVELSDELKARRAEAQQREKQELHEAYVQFKDGTYEKVTETDEELGKLYWGTYLLVNRAREASRMSLRD
SLWKWNEEKGIWVERDPKFKSLDDEVIFGVELQKGDSVERVLNCQNTMFQLDMEPEMGEEVLRHRRIRRRGIARIR
VGSGGKSGRDPIWAEFPVIMHRPLPPKARIKWAVVKREKITTRLRWTLHLHLEVDSGDCHKDYGTGRGVVAVDIGW
RKRGTETVEMGRKRKKRGLRKQEVEVPRIRIAYLIDDREYAAYLKNPDEGEVGHEQCMSSKVVAGFQRVETLQQTR
QLKQNEMLAELRAWIKARRSALPKWFRESTRGIAKWEAPKRFAWLLRLWRESRWKGDERGFEILDRWQRGVYDEEA
RRLEGGDRHLWQWQESQRRKSLLQREDHYRCVDSALAREFKVLVLENIDLSKMQKHELPGSDKVEIRRARRQQKEA
ALSEFRETLIQAFLSRGGTVVWVNPAMTTQRCFDCGHDAPWDPIPKVEHTCEKCGRTWDQDANAARNMMRLYRENK
IVKIADGSVLVREMSDAQKNRNKGKKVVRKRKKEEEERNGEGPAPLES (SEQ ID NO: 125)

>3300017971|Ga0180438_10000124_114
[aquatic-non marine saline and alkaline-hypersaline lake sediment]
MGAARRRNPKVAAARKGKPPPKATGNCRNYRYGAHEPIANLDKVLDEMRGAHDLRNVLTCINRARSEMITAALGEH
QSYKKATADLAALHQRRDKLEAQIRQQNSASRKRLGRHSPLSSELDTVRKRIDEGRTALKKLRRKLLKKDPALKAV
VEAADDMAKRETTRAEDACGLYWCTRNEQTGKRAKLRRFKKWRDSEATISVQIPGGLTVEQLLGGENNQARLELRP
EGVWVQGARKRKVEPAEAARNKLRLDEDGYPMRKLGTAILHLRCMSDEDGKPIWAEVPITYHREIPADAKIKRCYL
HRFRVGNRYHWSVRFSLERGKKGDDSWLHPRVATTGTAAIDIGWRWFPDRLRVAVWAGSDGAEGELCLPKWWLDEM
YSVRLDQRERDVLFNEIVSLVLPWFRSRRGELSDYVVQAIKTMHSWRDKGRLAALSMRWRDDLAADPGANPAHVAM TABLE 2-continued Amino Acid Sequences of Representative CLUST.018837 Effector Proteins*

SIRLEEWRKRDKHIWCEEVNLRSQLQGSRKDLYRRFAAMLTSRYGRIVVEEFDLSAVQKLPPASIDDGTYSRVKRH
KGDAACSHLVGALKDAARQLDKKNPKWTTKRCHLVCGKTERKWENPGELEHTCKHCGVLWDRDVNAARNILAASGVA
VDWTRPPLAPAARMTYPQVENREMRRSRRRKEALETTRASGDRQTA (SEQ ID NO: 127)

>3300017971|Ga0180438_10000195_144
[aquatic-non marine saline and alkaline-hypersaline lake sediment]
MTKTYVYGLPLPGPTVNADLVEEQMRLAHKYRNALIEIERERREKVREVYDERDLALEGLVEEDKVAKSELKRATED
LKRQRAKTRSRSDTAEQRARVKEARKAAQEVAKRLSEARKELKLDEELQKRLSEANLTASEKSQAAQQGFSREGLF
WGTYLQVDNAMEDSRRDLKMWDEHGQPLDPKFLQWRGDGTVAVQLQGDKHPVEKIFSGEDTFLQVDMEPPPEGVVS
KTRRKKRRGVMRLRVGSTKSRGPVWAEFPIIMHRPLPQGVRIKWAVVKRRMISDRPRWTVHFSLGLPAEYQHEEFG
SGRGAVAVDIGWRKRGEDQIRVAYLVDGDEYAAYLRDRQDPLGRGDELLMEPEVVRGFDKVESLQSIRALNQNEMQ
KSLKGWIKSNKKNLPEWFREDVRYLHSWKSPKRYAGLLRKWGEKRWDGDGEGFQILKDWLSGTYEESLGRRDGGDR
HLWQWKESQEQKSLRRRKDHYRRVAAKLARKYKVLVIEDFKLTETQKHEPPESEKVEIQAARNQQKEAACYELRMM
FVQAFLARGGTVVWVDARMTTQRCFECGCLEPWDAIPEVDHVCVECGAKWDQDANAARNIMRLYRNDETLKMIDGS
VPVEPKMSRRQKGRKKGKKIVQQRKSQEAAQPSV (SEQ ID NO: 124)

>3300017971|Ga0180438_10013386_7
[aquatic-non marine saline and alkaline-hypersaline lake sediment]
MRVYKYGLLRPTTNADLVHEQIKIGHKYRNKLIELEIKRRDLIRAEVAKSSVVEDDFTDAKLAVEKFKHLDKLLKQ
KNAQHRSKRHNNPDLKKDHTKARKEKTKAIKKLEETRRKVLKKCKETIKVFNDQYIEEEKKVRSECAPFWGTYQVI
EDAMKRSRKSLPLWDGLESNNPKFRRFNGIGRVSIQLQKDVIDKNNGMNVDLVFGTTDTRLQVAPVPEEAWYSPIR
SVRRKKSRTVLKMRIGSEGRAPIWAEWPMIMHRPLPDNGIRKRVTVNERKIGPREEWTADFFINDSATLHEQYEVS
GAIGLDVGWRLMDDGSLRVAFWEDDEGEKGEFRLSPTLMGAFKKADDLRSIRDKNRDEIKEFLIQHFSKNPMPSWM
LDFVKGKEDSKRPTNKQACVYLSKWKSIAKLTKLVQTWKEKGITKRHQKAYNRFEDWRYHDPFHLWQWETSQRKKAE
RRRKDNYRVLASKLSKQYHTLVLENFDLRKVARKKAADDDSLDIKAANHNREVANISELRLVLRNAFEKCGEIELV
KAVNTTKICFWCGFINNFDQAKNLIHQCYSCGVVWDQDDNASTNIRRRRKQG (SEQ ID NO: 126)

>3300017971|Ga0180438_10021273_1
[aquatic-non marine saline and alkaline-hypersaline lake sediment]
MPRNPKKKMDGVGRNYKYGAYAPLTNEDEVRWQMVLGHRYRNRLVEVELDIRAKRDAIIQEVAPGLLALEDEINKM
GEIIALHEKAQKEQNKKQRGRDVHPGVANLLRDLKAEKKGLVGKRKALKAELFASDRWKQDGGDHLNQQRKEGRSN
AYSEYKDEGLWWGVRSKILRESGSFISGAPPKFRGWHKSVRSTRFVVQTQGGLTEEELLSGRNTTARLTLFPDGVW
AEGKRRPKRMGDAILDLRIGSDEHRKPIWTSIPISYDRHLPAEAKIKWIYLFKRLLVDKEKWEVVFALECPAAADY
DAIRRRGGDKKRTNRNRKGIRLRKYAQSGVVAIDVGWRKFEDYLLVGTCAASDGREWELRLDGNWLGQLRRVEGMQ
SYRDVLLNEQVKWLHPWLKSRKGSLPELLLPPSRNLEKWGQRSVARLVKQWMRERPIGTLDEQRALARLDEWLSRE
NHVWHFQANLQHQLLLYRREEYRVWARRIGEVYRCVVLEKLNYGDWHKKPPVERGGSVKADMAKKYLRDAGLSHLK
NALKRGVLQVADVPHEGTTVNCHACGHADVWEDPAAKDHVCETCGLRWDRDVNAARNILAASGVTVAWEREPLAPT
EAWTACSKSGLNRAQRRAISSSLAIDSEIALAVGGSE (SEQ ID NO: 131)

>3300017971|Ga0180438_10044179_5
[aquatic-non marine saline and alkaline-hypersaline lake sediment]
MIVYQYGLRAPTSQIELIHDQLWLSHRYRNTLVEIERGRRAAVRRLVPLLEQQTKEAGERVSEASKAVKQ
YRSKNRTRKVPEWMRTELDAARLEKKDVATKLREVRKQLRTPEIQAEMDRINGLAGELRRSARAHCGLYWGSYLLV
EDEMASSSKSPLYDKENPNEPNDPGFVRWHGEGHLGVQIQGGMPTGLVQFHSTLLQIKKVDPVEGKLGKSHYLLRM
RVGSNGRKPIWGEWPMVMHRPLDPGQIKGAAVSCRRIGLRWQWTVEITVDKESGCRPRPCGYGQVAVNFGWRKVDG
GIRVAYAVDYEGNEQELVLPDGEAEGIVRPSRVRERLTDEQRAIQKRDGLIYGKACRLSDDGKSYEAEKVLSGRPD
LLSRLSSRVRPARKPPILPALRKSDELRSIRDQRFGHILQSLIKWLKTIEVPCWLKDRTSHIHKWKSQNRLRKLIG
YWRSNRFDGDETMFQSLEVWNHRDEHLLSWEDSQRKKSQRRRRDLYRVWAAKLADRYYTIVLNSHDMAETARKPKV
EATDDIPLSRSNRQLVSPSELKEALINAKRSREGQTVENPAQKVTHTCHNCETEQDFDAASSIEHTCLACGETWDQ
DRNAAINSLRWFVERPSDAKILGTARKIKNLDENGVEKETRRQRISRLKREKDARMKALANDAASS (SEQ ID
NO: 132)

>3300017971|Ga0180438_10056790_2
[aquatic-non marine saline and alkaline-hypersaline lake sediment]
MSRFHKDRLKVDAKIFSFNASEPMEGLEVIRSEMKLAHDYYNKLVELERARRSEIEEEQLRRFPELLRIEEEIAVA
EDSLVDLVRETKRRNSSRRSAKLPKEDRERIKIARGVLRELCKRRSEMKKGLRENADYQEAEKGITKKAKGAAKEA
RHESGCFWPNYLQVEVAVESAKKPRKRRKGQRPVRWTYRPRFKRWEGRGRVSMQLQKGLSPERLESGADTRLRLVR
GRVTKPGPRRERKQGTAMLWIRVGSTKEPGKRAQPVWAKVPFYYGGRRERLPPDCSIKWCWLLVDKIGLKERWRV
QFSIDAPLGTLKHVDRASDGTVAIDIGWRLMGDRLRCAIWSGSDGEEGEIALTGSWVRAYSRERAMRSYRERLFNC
VLKELCSWAKEQEVLPEPLAEARALHAWKKHGKLASLSLKWRGKRDFRERSEKAASYLREGGVVDLSGASEDDVLA
LLEGWRKRDKHVLEYESHLRDKLQATRLDLYRVCVANLRRRYKTCVLEEDVEDDERTKLMDLVKWHLLPDVIEAGD
PGEEEQRRASKRGLRPACLFKLRAILKENMEIVGVPSEFTTKRCWSCGSVEEWDQASEVEHTCENCGETWDQDVNA
ARNLLVASGVEATFFRPALAPAEVWTCGLRGTFPEPV (SEQ ID NO: 133)

>3300017971|Ga0180438_10072596_2
[aquatic-non marine saline and alkaline-hypersaline lake sediment]
MFGHDSLPSRIYRYGAKAPTVGAENVDRQMSLGHRYYNTLVEIERRREKAAALVARVSPALASLEQRREALTAAI
AERREAVKKSNQEVRKKQATKDERDAIAALTAERKEVNVLYRDAKDLAYNSPEAAAGLAAIDQQADMEAKTARAES
GLYWGTYLQVEQSLPRKGPPPKFHRWMGDGKIAVQIQGGMTLEEAFAGRDQRFRLEPIPDNAWDKGNRKHRRTRAW
IRVASDGRDPVWAVVPVVLHRPIPDDAQIKWVYLLRRRVGCNNNWSLCLVISRQAWQRHDLAGDGAVGINLGWRKV
EGGIRVATWVGDDDESDTLVISERDAGRWQKAKDLRSIRDGRFNAIQEALVDWLGSHAVPEWFSERTATIKQWRSQ
ARLAALVIAWRSQRFEGDEGIFPAMEAWRKKDKHLYEWEANQRRKAVAWRNDLYRCFAAKLSQRYETAVLGKTDWK
TIGRRPSPENPEHASGGENRTLASPGILQRMIVERVARVELADAKHITQRCHACGKLASFDARTNIFTTCRHCAET
WDQDENAARNLLLSASGPVAQKTP (SEQ ID NO: 134)

TABLE 2-continued

Amino Acid Sequences of Representative CLUST.018837 Effector Proteins*

>3300017987|Ga0180431_10022214_3
[aquatic-non marine saline and alkaline-hypersaline lake sediment]
MRVIVYEYGLRQPTSGIDDIDDQIHRAHRYYNKLIEIERWRRAQVKKAQLQVPEVANTKKVVEALREDLEALRTQH
KRAKSHDGKTHPPRAGAIKDTTAALKAARQGYRQAKKDAADILKPLYKKVDEERNALVRQARGESGVYWGTYLCIE
QFASQAAQTAKRESPDFRRWTGDGMLAVQIQNGLDAGALFGDDTRVQVAPIDSKAWDKSISRGKRKRMQYTTLRLR
VGSTGPGNREPVWAEWPLFMHRELPADASIKWVRVIRRRWDQRWKYRWVVQFTVEVPEAPGWQGEGTRKGMVAINL
GWRKLATDALRVATWVDTEGNVGELQLPVSFRQRLEKANSIRSIRDRKLDELKAAIVPLLPECSRWKSPKRFEGLL
RQDDLPDGVRDLVNKWAYRDRHLWWFERGCRQGALRYRREIYRLFALEMAKKYPLVIVEDYDLRPIVTDENRIKLP
SHQRVEGSPSEARHVLLASVSRLGGMVIDGKSKLATQECHLCGYGKEKDERWDASPKIEHTCVGCGENWDQDVNNA
RVLLARAQVMLESGELLAQPKPKRSARFAKKHKKQNEAVL (SEQ ID NO: 135)

>3300017987|Ga0180431_10041976_5
[aquatic-non marine saline and alkaline-hypersaline lake sediment]
MFGHDSLPSRIYRYGAKAPTVGAENVDRQMSLGHRYYNTLVEIERRRREKAAALVARVSPALASLEQRREALTAAI
AERREAVKKTNQEVRKKQATKDERDAIAALTAERKEVNVLYRDAKDLAYNSPEAAAGLAAIDQQADMEAKTARAES
GLYWGTYLQVEQSLPRKGPPPKFHRWMGDGKIAVQIQGGMTLEEAFAGRDQRFRLEPIPDNAWDKGNRKHRRTRAW
IRVASDGRDPVWAVVPVVLHRPIPDDAQIKWVYLLRRRVGCNNNWSLCLVISRQAWQRHDLAGDGAVGINLGWRKV
EGGIRVATWVGDDDESGTLVISERDAGRWQKAKDLRSIRDGRFNAIQEALVDWLGSHAVPEWFSERTATIKQWRSQ
ARLAALVIAWRSQRFEGDEGIFPAMEAWRKKDKHLYEWEANQRKRAVAWRNDLYRCFAAKLSQRYETAVLGKTDWK
TIGRRPSPENPEHASGGENRTLASPGILQRMIVERVARVELADAKHITQRCHACGKLASFDARTNIFTTCRHCAET
WDQDENAARNLLLSASGPAAQKTP (SEQ ID NO: 136)

>3300017989|Ga0180432_10002388_5
[aquatic-non marine saline and alkaline-hypersaline lake sediment]
MRVIVYEYGLRQPTSGIDDIDDQIHRAHRYYNKLIEIERWRRAQVKKAQLQVPEVANTKKVVEALREDLEALRTQH
KRAKSHDGKTHPPRAGAIKDTTAALKAARQGYRQAKKDAADILKPLYKKVDEERNALVRQARGESGVYWGTYLCIE
QFASQAAQTAKRESPDFRRWTGDGMLAVQIQNGLDAGALFGDDTRVQVAPIDSKAWDKSISRGKRKRMQYTTLRLR
VGSTGPGNREPVWAEWPLFMHRELPADASIKWVRVIRRRWDQRWKYRWVVQFTVEVPEAPGWQGEGTRKGMVAINL
GWRKLATDALRVATWVDTEGNVGELQLPVSFRQRLEKANSIRSIRDRKLDELKAAIVPLLPECSRWKSPKRFEGLL
RQDDLPDGVRDLVNKWAYRDRHLWWFERGCRQGALRYRREIYRLFALEMAKKYPLVIVEDYDLRPIVTDENRIKLP
SHQRVEGSPSEARHVLLASVSRLGGMVIDGKSKLATQECHLCGYGKEKDERWDASPKIEHTCVGCGENWDQDVNNA
RVLLARAQVMLESGELLAQPKPKRSARFAKKHKKQNEAVL (SEQ ID NO: 135)

>3300017989|Ga0180432_10021155_3
[aquatic-non marine saline and alkaline-hypersaline lake sediment]
MYRYGLLPPSSGAELVDEQMWLVHRYSNELVEIERARRKGFHAALAVVPEVAEALRVEEEALARYHVLRDSDSDDR
AAEFRKKGKRRRKSSPAVADALAALKAATDAVEDVRAAAVKAIGRDSKKKKTAKKKKKKKTATELVKMTPAEVASV
TEAINENDAVHGDAAKRKRAEFIAQGLYWGNYQVAEASIPRKGPPPKFRRWEGRGHIAVQIQGGMTYAELLSCNHT
MARLEIRDDWGSNRRTSRHGLLWIRVGSKGKGGREPVWATFPVCWHRHLPEGARIKRIDVTRRIQGVRAVWAVCVT
VQTPGASLTKQALVKPVTKALPKAVGLDVGWRSTDDGGIRVAVLYDGDRHYEVALPHWFAEGDRLVSDLQSIRRCR
FNAVKDQLLAALREGKHKEQAETFATLASWDSQARLARAVREWEGCPAYLTEWRAKERHLYQWERDAKRYLVEWRK
NWYCHWVAWISQRYKNVVIEKFDIAKIKKKAEAGEDKEEATGPHSLAAPGELRRILLSTCSREGVQVHLAPAGNTT
RKCSVCGKLRRKKKGEGVALMQECSGCGRVMDQDANASRNLYGFASAGVIPETPVAFAVPEAAWYGRFSLTPKKIQ
SRVARLQAALETSPPDSDGKGG (SEQ ID NO: 137)

>3300017989|Ga0180432_10021155_5
[aquatic-non marine saline and alkaline-hypersaline lake sediment]
MAFHHSTQPTTSRVYRYGLLPPSSGAELVDEQMWLVHRYSNELVEIERARRKGFHAALAVVPEVAEALRVEEEALA
RYHVLRDSDSDDRAAEFRKKGKRRRKSSPAVADALAALKAATDAVEDVRAAAVKAIGRDSKKKKTAKKKKKKKTAT
ELVKMTPAEVASVTEAINENDAVHGDAAKRKRAEFIAQGLYWGNYQVAEASIPRKGPPPKERRWEGRGHIAVQIQG
GMTYAELLSCNHTMARLEIRDDWGSNRRTSRHGLLWIRVGSKGKGGREPVWATFPVCWHRHLPEGARIKRIDVTRR
IQGVRAVWAVCVTVQTPGASLTKQALVKPVTKALPKAVGLDVGWRSTDDGGIRVAVLYDGDRHYEVALPHWFAEGD
RLVSDLQSIRRCRFNAVKDQLLAALREGKHKEQAETFATLASWDSQARLARAVREWEGCPAYLTEWRAKERHLYQW
ERDAKRYLVEWRKNWYCHWVAWISQRYKNVVIEKFDIAKIKKKAEAGEDKEEATGPHSLAAPGELRRILLSTCSRE
GVQVHLAPAGNTTRKCSVCGKLRRKKKGEGVALMQECSGCGRVMDQDANASRNLYGFASAGVIPETPVAFAVPEAA
WYGRFSLTPKKIQSRVARLQAALETSPPDSDGKGG (SEQ ID NO: 138)

>3300017989|Ga0180432_10043261_1
[aquatic-non marine saline and alkaline-hypersaline lake sediment]
MSTKVYKFRLYAPILNGDLVEEQLKLANAYRNKLIELERDRRVVARELNAERRSVLGEYIDAAEELKTRLKREVNR
LKAMKAMKARGARKSPELKDQEKLVTQIRQERKAAVEDLKAREANLKTTSELQAKYDKLWEDLTNKTKEERNLNGL
YWGTGGFQEQAMQKSSETLHLGKDPRFKRWDGCGTVAVQVQKPLQMPLKDFFHGKSTLINFIMDDEGASGTKRHGV
VQLRVGSDRKKPIWAEWPLVMHREMHERAVITGAQIHKTRTADKFKYHLCVTAKLPDDVRKERCGDGVVALDIGWR
KLLDGNLRVAYWKDREGNGGQLVLDPAVLSGLGKDASLQAICRGLLNKLYKAFYTWLSSVANLPENFQQIYEEMTA
EKAYWKEFRALQKIVREARAGGLPELDALEEKLAEMKARQKEVRTWKVQGKFSGLLEDWRNNRWDGDNAGFTMLDD
WWRGTYNPESGHREGGCKHLWQWRSNQREKSQRRRKHQYRNLGAEFSRKAGVLVLENFDLTDMQRDAEPEEKKKNP
EAKLNQRYAACYELREAFIQAFQSRGGRVVKIDPQMTTQICARCGCDTRWDAALEIEHTCERCGATWDQDENAADN
LLKLYEGGGSIQEVTVVKKDPRWKRLKAEKAAKLEDRGGARKD (SEQ ID NO: 139)

>3300017989|Ga0180432_10045094_6
[aquatic-non marine saline and alkaline-hypersaline lake sediment]
MVTEYTTKVYTCGLRPPAENADLVSEQIRLGHRYYNRLIEIEHEKRQRDHEIVGAHGDADALQAAIDEQVVVVEQV
VARIRRWRIANGKKVASKDLRMELAAAKKSLKAARAELRELRRVIYKQDPEIAASRVALWAEDSAARKRARAECGIP
HGTYIQVEQAVEEAACKAPMAPGCETPWWELPRFKRWGEGCVGLQLQQRDGEYMDTDALFGRSDPRLQIDPVPSTA
WDRRRSREQRTVVRMRIGSECRRCGALCTSIHCPEGGDGGAAYRSPVWASWPMILHRPLPEGALIKWAKVKRERIV
GKARWRWSLHLTIDEPEQEPRCGEGGTVAVDVGWRKTETGMRVGYWQDDSGDHNSINIDHEILDRLRKVDELESIRK
RNMNAAKSQLRAWLATWEEVPDWMREASRHMHAWRSQNRLAGLALHWRQNRWEGDNPGYEDLEDWRKQDKHLWAWQ
DNLRGKVLRRREVYRVAAARLAERYDTVVLTDFDLRDTQRHPSDTSTREEIDAVKWQQKAAACSVLRGCIRNAFT TABLE 2-continued Amino Acid Sequences of Representative CLUST.018837 Effector Proteins*

SRGGRIVEVEAKLMSRTCHGCGHDGEWAKPEELEHTCQGCGETWDRDVNSTTNMLRAARERSDDDDGRPKKRAAKW
AKRHGRSKNENDDDGTSRNAGDKVA (SEQ ID NO: 140)

>3300017991|Ga0180434_10002646_1
[aquatic-non marine saline and alkaline-hypersaline lake sediment]
MRVIVYEYGLRQPTSGIDDIDDQIHRAHRYYNKLIEIERWRRAQVKKAQLQVPEVANTKKVVEALREDLEALRTQH
KRAKSHDGKTHPPRAGAIKDTTAALKAARQGYRQAKKDAADILKPLYKKVDEERNALVRQARGESGVYWGTYLCIE
QFASQAAQTAKRESPDFRRWTGDGMLAVQIQNGLDAGALFGDDTRVQVAPIDSKAWDKSISRGKRKRMQYTTLRLR
VGSTGPGNREPVWAEWPLEMHRELPADASIKWVRVIRRRWDQRWKYRWVVQFTVEVPEAPGWQGEGTRKGMVAINL
GWRKLATDALRVATWVDTEGNVGELQLPVSFRQRLEKANSIRSIRDRKLDELKAAIVPLLPECSRWKSPKRFEGLL
RQDDLPDGVRDLVNKWAYRDRHLWWFERGCRQGALRYRREIYRLFALEMAKKYPLVIVEDYDLRPIVTDENRIKLP
SHQRVEGSPSEARHVLLASVSRLGGMVIDGKSKLATQECHLCGYGKEKDERWDASPKIEHTCVGCGENWDQDVNNA
RVLLARAQVMLESGELLAQPKPKRSARFAKKHKKQNEAVL (SEQ ID NO: 135)

>3300017991|Ga0180434_10013735_9
[aquatic-non marine saline and alkaline-hypersaline lake sediment]
MFGHASDPSVIYRYGALPPTHNLDAAFEQLRAAHRYRNKLVEIERDRRDKTAAVVSAASPDLAGLESQYAELGERT
AAAAKQIKATNQRARAQRATPEQKAVLRKLRAECKDVYSRLKEAKALAYKSLEARTALDQADAAALNAAKKARAEC
ECYWGTYLQVEQGLSGIRKGAPPRFLRWTGNGKLAVQIQGGMSREEAEHGDGRLRIATTERRGKATNVYLRIGTNE
DRSPIWAVVPVIEHRPIPDDARIKWVYLTARRVACHTRWHVCFVLSRAEGWRKPDLATSGTVAVDLGWRLLDHGLR
VGYWRGSDGGSEEILLPTRDVARWQKADDLRAIRGERFNGVVDWLAKWLAGRDLPDWLIERTRTLRQWRSAARLAS
VVIHWRENRFAGDKDGFAAVEAWRKKDKHLYEWEANQRRKAVAWRDDLYRRVAADLSRRYKTAIVEDCNWRDVGRK
PDVGENNDSGAAARQRTIAAPGRLKQLLVERFAETVKAEAAYTTQRCHACGELAHVETRTSVWVTCQQCGAAWDQD
DNACRNMLDMVAKGPVT (SEQ ID NO: 141)

>3300017992|Ga0180435_10018121_11
[aquatic-non marine saline and alkaline-hypersaline lake sediment]
MTKTYVYGLPLPGPTVNADLVEEQMRLAHKYRNALIEIERERREKVREVYDERDLALEGLVEEDKVAKSELKRATED
LKRQRAKTRSRSDTAEQRERVKEVRKAAQEVAKRLSEARKELKLDEDLQERLSRANLTASEKSQAAQQGFSREGLF
WGTYLQVDNAMEDSRRDLKMWDEHGQPLDPKFLQWRGDGTVAVQLQGDKHPVEKIFSGEDTFLQVDMEPPPEGVVS
KTRRKKRGVMKIRIGSTESRGPVWAEFPIIMHRPLPQGVRIKWAVVKRRMISERPRWTVHFSLGLPAEYQHEEFG
SGRGAVAVDIGWRKRGEDQIRVAYLVDGDEYAAYLRDRQDPLGRGDELLMEPEVVRGEDKVESLQSIRALNQNEMQ
KSLKGWIKSNKKNLPEWFREDVRYLHSWKSPKRYAGLLRKWGEKRWDGDGEGFQILKDWLSGTYEESLGRRDGGDR
HLWQWKESQEQKSLRRRKDHYRRVAAKLARKYKVLVIEDFKLTETQKHEPPESEKVEIQAARNQQKEAACYELRMM
FVQAFLARGGTVVWVDARMTTQRCFECGCLEPWDAIPEVDHVCVECGAKWDQDANAARNIMRLYRNDETLKMIDGS
VPVEPKMSRRQKGRKKGKKIVQQRKSQEAAQPSV (SEQ ID NO: 142)

>3300018065|Ga0180430_10011859_2
[aquatic-non marine saline and alkaline-hypersaline lake sediment]
MFGHKADPSLIYRYGAKTPIEHCDVVDAQIRAAHRYYNQLVEIELRRREQATELVRSLSPELDTLTEWREELSETI
DSVRAEIKAANQRARRKTTTKAQRDQVKALRKQRKAVTELWREAKAAAYDSPDAKAGLAAIDEAANESRRQARAAC
GVYWGTYLAIEQSIPKTSAPPTEHRWTGDGRVVVQLQGGMSAAEAFACRDNRFRIEPVPEEAWDRGQPKRLQRTRA
WVRVDSDGRDPVWAVVPITLHRPFPEDCRIKWVYLIRRKVASKDKWSLCLVLSRVEGWQKTDLGASGSVGIDLGWR
LVAEGLRVAYWAGDDGESGSVVLPMRDVGRWQKARDLQSIRATNEDAIVLRLAGWLAGRELPDWLTERTKTLRQWR
SQGRLAAVVIQWRAEREDGDAEIFAEVEAWRKQDKHLWEWEHNQRRKAIAWRENVYRQFAAMLSRRYRVVCLEATD
WRHFMRKVAAEEDGQGGAGAQRYLRIASPGQLSRLLAERFAEVVRVDPKHTTQRCHVCGELAQFDAATSLHTKCRH
CGAEWDQDYNAARNLLGAASGPVPQETP (SEQ ID NO: 143)

>3300018065|Ga0180430_10038979_3
[aquatic-non marine saline and alkaline-hypersaline lake sediment]
MEGNKALPSVIYKYGARRPVTNADEVDRQVRDAHRYRNKLVEIERDRRSCVNAKLMQLAPRLLSLETEIERLDNLI
AEKRSEIKRANATRRRRDVTPEQRAELRQWQADRKALRTELKERKADAFADPRIRTALAKVDAEALAASKAARAAS
GVYWGTYCQVEQSLSGMRSGAPPRFLREDGTGKLAVQLQGGLSVAKAFAGEDRRLIIEPVPPKAYLPGEPKALQRT
RVWLRIGSDGREPIWTIVPITLHRPLPDDASIKWVYLTRRRVATKDRWSVCFVLARESGWQKPGLARNGSVGVNLG
WRVMDDGVERGLRVARWVGDDGTEGELRLPMPDVERWKKTEDLQAIRDQRFNAAVSLLADWLADPGCLLPDWLVER
TATLRQWRSAARLAAIAIQWRGERFEGDDTAFATLEAWRKKDKHLYEWQANQLRKAIAWREDLYRNLAATLSRRYH
TVCLANTDWRDLARRPTAEQAETDAGARRYQRVASPGALGRLLRERFAETVTVDSRHITQRCHACGEVNQFDAAAH
VRATCRHCGAEWDQDINAARNILRAASGPVACETP (SEQ ID NO: 144)

>3300018080|Ga0180433_10006034_17
[aquatic-non marine saline and alkaline-hypersaline lake sediment]
MRLANRYYNCLVVIERERRQAVRDALQECDQRHGIDALQDVVDTLKTQRDEAREEIKRARSKTRSRSDTEDQRKRV
KDLTVQIKEACELVKRARRDIRDDEQAKEQMKAADNIARTKTREARAICGVFWGTYLTIEAAIDAARKAPLWQYGK
PNDPRFRREGGRGSVSMQLQGGLAASDVFGDDRRLQIELSPQRKSNSNRSKIRRYGVIRLRVGSSKRDPIWAEWPL
LMHRQLPDLSTIKWARIVCDRVANEERWSLQLTIDIPEPVKVSDERKGTVAINLPGWRLLDYGVRVGYIVDDCNETD
EIVIDPGVLSGLRKVEDLRSIRDRTQNTMMEEFLPWLRSHKNILPAWLTERTKTIGQWKAAARFAALAHVWSVSRF
GGDVLGYELLEQWRKQDLHLWQWESFQRRKSIGRRRNQYRRLAKQLAHRYHTLVLDTTNLAEIQRHKSTESEEIEI
PAARLQQRDAATAELRSYLAEAFHATGGVVVKVNHKRATRRCHVCGHEGPWNQCDEVVHKCESCGSSWDQDENNCR
NLLERLGDGDKITTKRQAKWDRLGRHNKTARKLDDNDVEIQTN (SEQ ID NO: 145)

>3300018080|Ga0180433_10006034_18
[aquatic-non marine saline and alkaline-hypersaline lake sediment]
MPTKVYKYGVRPPTKNADIVHEQMRLANRYYNCLVVIERERRQAVRDALQECDQRHGIDALQDVVDTLKTQRDEAR
EEIKRARSKTRSRSDTEDQRKRVKDLTVQIKEACELVKRARRDIRDDEQAKEQMKAADNIARTKTREARAICGVFW
GTYLTIEAAIDAARKAPLWQYGKPNDPRFRREGGRGSVSMQLQGGLAASDVFGDDRRLQIELSPQRKSNSNRSKIR
RYGVIRLRVGSSKRDPIWAEWPLLMHRQLPDLSTIKWARIVCDRVANEERWSLQLTIDIPEPVKVSDERKGTVAIN
PGWRLLDYGVRVGYIVDDCNETDEIVIDPGVLSGLRKVEDLRSIRDRTQNTMMEEFLPWLRSHKNILPAWLTERTK
TIGQWKAAARFAALAHVWSVSREGGDVLGYELLEQWRKQDLHLWQWESFQRRKSIGRRRNQYRRLAKQLAHRYHTL TABLE 2-continued Amino Acid Sequences of Representative CLUST.018837 Effector Proteins*

VLDTTNLAEIQRHKSTESEEIEIPAARLQQRDAATAELRSYLAEAFHATGGVVVKVNHKRATRRCHVCGHEGPWNQ
CDEVVHKCESCGSSWDQDENNCRNLLERLGDGDKITTKRQAKWDRLGRHNKTARKLDDNDVEIQTN (SEQ ID
NO: 146)

>3300018080|Ga0180433_10012134_6
[aquatic-non marine saline and alkaline-hypersaline lake sediment]
MWLVHRYSNELVEIERARRKGFHAALAVVPEVAEALRVEEEALARYHVLRDSDSDDRAAEFRKKGKRRRKSSPAVA
DALAALKAATDAVEDVRAAAVKAIGRDSKKKTAKKKKKKTATELVKMTPAEVASVTEAINENDAVHGDAAKRKRA
EFIAQGLYWGNYQVAEASIPRKGPPPKERRWEGRGHIAVQIQGGMTYAELLGCNHTMARLEIRDDWGSNRRTSRHG
LLWIRVGSKGKGGREPVWATFPVCWHRHLPEGARIKRIDVTRRIQGVRAVWAVCVTVQTPGASLTKQALVKPTTEA
LPKAVGLDVGWRSTDDGGIRVAVLYDGDRHYEVALPHWFAEGDRLVSDLQSIRRCRFNAVKDQLLAALREGKHKEQ
AETFATLASWDSQARLARAVREWEGCPAYLTEWRAKERHLYQWERDAKRYLVEWRKNWYCHWVAWISQRYKNVVIE
KFDIAKIKKKAEAGEDKEEATGPHSLAAPGELRRILLSTCSREGVQVHLAPAGNTTRKCSVCGKLRRKKKGEGVAL
MQECPGCGRVMDQDANAARNLYGFASVGVIPETPVAFAVPEAAWYGRFSLTPKKIQSRVARLQAALETSPPDSDGK
GG (SEQ ID NO: 147)

>3300018080|Ga0180433_10012134_6
[aquatic-non marine saline and alkaline-hypersaline lake sediment]
MAEHRSTQPTTSRVYRYGLLPPSSGANLVDEQMWLVHRYSNELVEIERARRKGFHAALAVVPEVAEALRVEEEALA
RYHVLRDSDSDDRAAEFRKKGKRRRKSSPAVADALAALKAATDAVEDVRAAAVKAIGRDSKKKTAKKKKKKTATE
LVKMTPAEVASVTEAINENDAVHGDAAKRKRAEFIAQGLYWGNYQVAEASIPRKGPPPKERRWEGRGHIAVQIQGG
MTYAELLGCNHTMARLEIRDDWGSNRRTSRHGLLWIRVGSKGKGGREPVWATFPVCWHRHLPEGARIKRIDVTRRI
QGVRAVWAVCVTVQTPGASLTKQALVKPTTEALPKAVGLDVGWRSTDDGGIRVAVLYDGDRHYEVALPHWFAEGDR
LVSDLQSIRRCRFNAVKDQLLAALREGKHKEQAETFATLASWDSQARLARAVREWEGCPAYLTEWRAKERHLYQWE
RDAKRYLVEWRKNWYCHWVAWISQRYKNVVIEKEDIAKIKKKAEAGEDKEEATGPHSLAAPGELRRILLSTCSREG
VQVHLAPAGNTTRKCSVCGKLRRKKKGEGVALMQECPGCGRVMDQDANAARNLYGFASVGVIPETPVAFAVPEAAW
YGRFSLTPKKIQSRVARLQAALETSPPDSDGKGG (SEQ ID NO: 148)

>3300018080|Ga0180433_10020043_6
[aquatic-non marine saline and alkaline-hypersaline lake sediment]
MRVYKYGLPWLLDEEEAPDGAKGGRMAVERQLRAAHVYQNKLIELIRARRLVHRDAVMGYGRVAELHKQVDDINEL
YQDARDDLKKTRQKERRAESDRQKAMVAKLRELYKESLAQLYKERRKAFRDSAVKELCKEADESFYEQQRQERTR
DLTDEERQRGWERPFWGTKQIVEASVKQAHESMPLWDGVRPNDPRFSWDGSGILGVQNQRPLFSTLNDEQQMDPA
VQDIFGKDTSLRVDPVDPEAWHNPKRCERKRKSRTVLWMRVGSDENRQPVWACWRMIMHRPLPDGAQIKRASVSKR
IVGERQKWTVQIYVDDQGCKRAPSCGDGSVTIDLGWRQQQNGVRIATWLGSDGRQGKFKLPQKVIERMFSERGIRK
TRDENLDRMRPCLEAWIRNQKCLPEWLEKRTKMIGRWRSHARFRALAQYWRGCRFPGDEEGYDMLEAWRYRDHHLW
NYERGRSMKSRGWRDQLYCQFGAWLARQYGTVVWENFNIAKMAKRPKLGDDYENERARAMRHAVAVATFRDKVENA
FDTRGGRSRYVSAVNTTRRCHVCGLVDAFDAASSVKRVPPCPGCGASWDQDENACVNMMETYDRGDSSSKPRKTNG
ARNGKKTNGNAVEGESHWARMKRLKREKDAHK (SEQ ID NO: 149)

>3300018080|Ga0180433_10021337_5
[aquatic-non marine saline and alkaline-hypersaline lake sediment]
MFGHASDPSVIYRYGALPPTHNLDAAFEQLRAAHRYRNKLVEIERDRRDKTAAVVSAASPDLAGLESQYAELGERT
AAAAKQIKATNQRARAQRATPEQKAVLRKLRAECKDVYSRLKEAKALAYKSLEARTALDQADAAALNAAKKARAEC
ECYWGTYLQVEQGLSGIRKGAPPRFLRWTGNGKLAVQIQGGMSREEAEHGDGRLRIATTERRGKATNVYLRIGTNE
DRSPIWAVVPVIEHRPIPDDARIKWVYLTARRVACHTRWHVCFVLSRAEGWRKPDLATIGTVAVDLGWRLLDHGLR
VGYWRGSDGGSEEILLPTRDVARWQKADDLRAIRGERFNGVVDWLAKWLAGRDLPDWLIERTRTLRQWRSAARLAS
VVIHWRENRFAGDKDGFAAVEAWRKKDKHLYEWEANQRRKAVAWRDDLYRRVAADLSRRYKTAIVEDCNWRDVGRK
PDVGENNDSGAAARQRTIAAPGRLKQLLVERFAETVKAEAAYTTQRCHACGELAHVETRTSVWVTCQQCGAAWDQD
DNACRNMLDMVAKGPVT (SEQ ID NO: 150)

>3300018080|Ga0180433_10021840_7
[aquatic-non marine saline and alkaline-hypersaline lake sediment]
MVDDQMRLGNRYYNRLIETECARRDAIREAMADNDRRHGLSDATARHARLDEQYNAAKEALKAKRSRARCRVDTAP
ERAAVRDLRAQRSKAAAELKEARKGHRGDSTMHAAFDAANEEAKLQRRASRAICGVYWGTYLQIEAAVDQAAKETS
LFFKGKPRDPRERRWGGSVMVATQLQGGLLALSALACDDSRLQIEMAELGPGPHSRRQLKLRKGTLRLRVGSDGRS
PIWAEWPLQMHRPLPENGVIKWAKVIRRMVSDRDKWELQLTVEISPEQPCHGEGTVAVDLGWRRKEDGTIRVGYVV
DDCGLEEETILDPGVVSGLRKSEDLRSIQDKAQAEMAARVIGWLKAQAELPPWLILATGFVDKWKSARRWRRLASI
WAEHPDVGSEALSVLSAWAADSLHLWRWEAHQRRKSCLRRKDQYRCLAKRLAAEYRHLVLESKFLAKLQRHVEAED
EDVEIKAVRLQQRDAAGYELKQCLIYAFRRANGTAVEVDPAMTPQRCNACGFVGRWDAAVEIDHTCEACGATWDQD
ANACRNLLERERPGDDSGQEAKRQGKWARKKAAKRTARKTVPSGAESFEAGV (SEQ ID NO: 151)

>3300018080|Ga0180433_10021840_7
[aquatic-non marine saline and alkaline-hypersaline lake sediment]
MIRVYRYGLRRPTTNADLVDDQMRLGNRYYNRLIETECARRDAIREAMADNDRRHGLSDATARHARLDEQYNAAKE
ALKAKRSRARCRVDTAPERAAVRDLRAQRSKAAAELKEARKGHRGDSTMHAAFDAANEEAKLQRRASRAICGVYWG
TYLQIEAAVDQAAKETSLFFKGKPRDPRFRRWGGSVMVATQLQGGLLALSALACDDSRLQIEMAELGPGPHSRRQL
KLRKGTLRLRVGSDGRSPIWAEWPLQMHRPLPENGVIKWAKVIRRMVSDRDKWELQLTVEISPEQPCHGEGTVAVD
LGWRRKEDGTIRVGYVVDDCGLEEETILDPGVVSGLRKSEDLRSIQDKAQAEMAARVIGWLKAQAELPPWLILATG
FVDKWKSARRWRRLASIWAEHPDVGSEALSVLSAWAADSLHLWRWEAHQRRKSCLRRKDQYRCLAKRLAAEYRHLV
LESKFLAKLQRHVEAEDEDVEIKAVRLQQRDAAGYELKQCLIYAFRRANGTAVEVDPAMTPQRCNACGFVGRWDAA
VEIDHTCEACGATWDQDANACRNLLERERPGDDSGQEAKRQGKWARKKAAKRTARKTVPSGAESFEAGV (SEQ
ID NO: 152)

TABLE 2-continued

Amino Acid Sequences of Representative CLUST.018837 Effector Proteins*

>3300001256|JG112210J13797_10495608_9
[aquatic-non marine saline and alkaline-hypersaline mat]
MARKTSKTPTKTYSYGARLDEGDMATARHILWMAQDYYDDRVRIEQARRLAYREARAQVCPWLRDAEVKIDLLELD
LEKVREELKSKRKSEFRRATGTDLATMAKELLALLKPMRKEARAQRKAASADPGVQAEGQRLDLLAKTLLKSCSKY
YGAKGLDWRTRGRVDDETRQAFADTASRPWRLGQCKKGFCGRVGGQVLAARGVELDTDRLFSDWSTVVQIDPLPDH
TWDTRSGRRKAITAGRISVGSLGPRRPVWLRFTAVIHRRPPRGIIKNAWLFFRERGGRVEAKFQFTLESEEFLRAS
PEPVHACATAMTPSRNLSAAVAVGTDGTIQYLSLPEKVWDRFEFAESIRSAADLAFDEVRPSLVEAGLIPHQSRSR
RRARRAAMGYAREALDAKAVWSTWRDERLGDGVDLWDSPDVVTDWAGRKGHDPLAVLCLVWSKKDGHLDRYEDNVR
HKARGYRSETYRTWVSALASKYRLFVDPYDAKYLKHAPNPEDDPRIANIERARSRMSLYSLMTTLREKGATEVEAD
AVEPGAAAHVMRAASVLAKAGEDTTKAVAKIEESRRMVEMARQLDAAE (SEQ ID NO: 153)

>3300001256|JG112210J13797_10495610_14
[aquatic-non marine saline and alkaline-hypersaline mat]
MARKTSKTPTKIYSYGARLDEGDMATARHILWMAQDYYDDRVRIEQARRLAYREARAQVCPWLRDAEVKIDLLELD
LEKVREELKSKRKSEFRRATGTDLATMAKELLALLKPMRKEARAQRKAASADPGVQAEGQRLDLLAKTLLKSCSKY
YGAKGLDWRTRGRVDDETRQAFADTASRPWRLGQCKKGFCGRVGGQVLAARGVFLDTDRLFSDWSTVVQIDPLPDH
TWDTRSGRRKAITAGRISVGSLGPRRPVWLRFTAVIHRRPPRGIIKNAWLFFRERGGRVEAKFQFTLESEEFLRAS
PEPVHACAIAMTPSRNLSAAVAVGTDGTIQYLSLPEKVWDRFEFAESIRSAADLAFDEVRPSLVEAGLIPHQSRSR
RRARRAAMGYAREALDAKAVWSTWRDERLGDGVDLWDSPDVVTDWAGRKGHDPLAVLCLVWSKKDGHLDRYEDNVR
HKARGYRSETYRTWVSALASKYRLFVDPYDAKYLKHAPNPEDDPRIANIERARSRMSLYSLMTTLREKGATEVEAD
AVEPGAAAHVMRAASVLAKAGEDTTKAVAKIEESRRMVEMARQLDAAE (SEQ ID NO: 153)

>3300005917|Ga0075115_10002831_4
[aquatic-non marine saline and alkaline-saline lake]
MAKVAKGEKMTEVYEYGLRPPSLNADIVDNQLILGNRYRNALVSIERKRRDAIRGWINKPVEKESIAYSEAIESFS
IAETAMKKQRASTRSRSDTADQRDEVKDLRKKKKDALSVLKAARVKAKKEELFKAEMDDVENQSKQEIKDARSECG
LYWGTYLVIEAAMAASRKKMPLWDKHEEPANPRYQRWQGTGTVAVQVQKSQQTTADHTMECTGRLIQLDMEKISDE
ERSKMSKRRQKRCEGTLRMRVGSEGRDPIWAEWPIIMHRPLPSDSTITEVRVIKKKISDHGKWNVHITIKTPDGYY
KQHNGVDDKCGSGPLALDLGWRLLGTGELRVAYTTDEDGTEEEIRLDHNILTGLKKSDELQGLCDDLQNKMKSTLN
EWKKTHHLPDWFAEESSHIHAWKKTHKEVRLLHSWSKNRWDGDSEGFDILNDWHFGAYKEDLGRRDGGSRHLWQWR
EHQRKKSLLRRKDQYRVLAARLSRKYSVLILEDLNLSKLQEHNKSEDDAVEIKEARWQQRAAACYELRECLKQAFL
SRGGRVLKVKAAMTTQRCFCCGCEKKWDPIPSINHTCDQCGKTWDQDANAAKNIMLLYDKKEFSEQSSGVKKEDAE
SLSKWGKIGRHKKTSLKLTDNQPEQLN (SEQ ID NO: 154)

>3300005918|Ga0075116_10002890_7
[aquatic-non marine saline and alkaline-saline lake]
MAKVAKGEKMTEVYEYGLRPPSLNADIVDNQLILGNRYRNALVSIERKRRDAIRGWINKPVEKESIAYSEAIESFS
IAETAMKKQRASTRSRSDTADQRDEVKDLRKKKKDALSVLKAARVKAKKEELFKAEMDDVENQSKQEIKDARSECG
LYWGTYLVIEAAMAASRKKMPLWDKHEEPANPRYQRWQGTGTVAVQVQKSQQTTADHTMECTGRLIQLDMEKISDE
ERSKMSKRRQKRCEGTLRMRVGSEGRDPIWAEWPIIMHRPLPSDSTITEVRVIKKKISDHDKWNVHITIKTPDGYY
KQHNGVDDKCGSGPLALDLGWRLLGTGELRVAYTTDEDGTEEEIRLDHNILTGLKKSDELQGLCDDLQNKMKSTLN
EWKKTHHLPDWFAEESSHIHAWKKTHKEVRLLHSWSKNRWDGDSEGFDILNDWHFGAYKEDLGRRDGGSRHLWQWR
EHQRKKSLLRRKDQYRVLAARLSRKYSVLILEDLNLSKLQEHNKSEDDAVEIKEARWQQRAAACYELRECLKQAFL
SRGGRVLKVKAAMTTQRCFCCGCEKKWDPIPSINHTCDQCGKTWDQDANAAKNIMLLYDKKEFSEQSSGVKKEDAE
SLSKWGKIGRHKKTSLKLTDNQPEQLN (SEQ ID NO: 155)

>3300011414|Ga0137442_1000121_10
[aquatic-sediment-groundwater sediment]
MKRKTSTTPTRIWSFGALEPTENQKALLDQLFFANRYYNTLIEIERKRRNRFREIRSEAVPELSMLEKRYQQLDAD
YVQMVAALPKPEKGKRKTLTPEVLANKEERKTTSARMKVLRAAFLEDADAKIQTAKADEEAQLAVKAARAATDLYW
GTYLLIERQVDEARKSKSDPDFRREDGQGRVGVQLQGGLSTPELLSGEDSRLRLQPRTSTPRVKKPKAQHEVRIRI
GSLGRDPIWATLPVIVHRPLPEDAEVKWAWVRIVRCGRRRIYSLQLTLESATFDRSQSGVGTVAINFGWRANEDGS
RRVAYAVDDAGKEQVLSIPASIEKDTTQANSLRSLRDLHFEEAKRSLVAFAALHPKAMPEWYAEEAKFLHQWRNPA
RLVRLAQRLAEEHPVDSNELLRWRQERLGGARFGRHWRSPGAPKQDLEAPFFEVMSWSTTRGIGALNFYLELWARK
DKHLWGWEASLRRSVDLRRNDLERTWAKRMTAYAEVRVEEFDLRKMTAIPAVGEEPRDSSERSAQRAASPGKLRER
IAEACGAKVMKGAAFHNTVTCFLCSHVNERSMEHRTVCAGCGEEFDQDANNCRNQLRERPSGAPEAGGARNPQKDP
VVSDGYDESTVDRDVPSGVVAAE (SEQ ID NO: 156)

>3300011431|Ga0137438_1001223_2
[aquatic-sediment-groundwater sediment]
MKRKTSTTPTRIWSFGALEPTENQKALLDQLFFANRYYNTLIEIERKRRNRFREIRSEAVPELSMLEKRYQQLDAD
YVQMVAALPKPEKGKRKTLTPEVLANKEERKTTSARMKVLRAAFLEDADAKIQTAKADEEAQLAVKAARAATDLYW
GTYLLIERQVDEARKSKSDPDFRREDGQGRVGVQLQGGLSTPELLSGEDSRLRLQPRTSTPRVKKPKAQHEVRIRI
GSLGRDPIWATLPVIVHRPLPEDAEVKWAWVRIVRCGRRRIYSLQLTLESATFDRSQSGVGTVAINFGWRANEDGS
RRVAYAVDDAGKEQVLSIPASIEKDTTQANSLRSLRDLHFEEAKRSLVAFAALHPKAMPEWYAEEAKFLHQWRNPA
RLVRLAQRLAEEHPVDSNELLRWRQERLGGARFGRHWRSPGAPKQDLEAPFFEVMSWSTTRGIGALNFYLELWARK
DKHLWGWEASLRRSVDLRRNDLERTWAKRMTAYAEVRVEEFDLRKMTAIPAVGEEPRDSSERSAQRAASPGKLRER
IAEACGAKVMKGAAFHNTVTCFLCSHVNERSMEHRTVCAGCGEEFDQDANNCRNQLRERPSGAPEAGGARNPQKDP
VVSDGYDESTVDRDVPSGVVAAE (SEQ ID NO: 156)

>3300011441|Ga0137452_1000071_9
[aquatic-sediment-groundwater sediment]
MKRASREAGQVVVYRYGCPSWADLPESGMVQLRLAHDLRNELVAVEYRYRELIDGIWSSQSAVSVAELALADATAA
VERAAALMLAQRKIDRSTIPRAGAKQALAEARAARREAKLTVKVAKAIDKEAAGPLLADAKAARYAAITSTRAEYV
VAGLFWATANDVVQNHDTAAKLVALAWKQGRPARRRTRPWKGTGTITTQVMWQAGKPARTPGVLASATSPWRNVER
IEPGRSRGEWPGQPSSGGTVRDDHATVHLRIEKGAEAICLPIVLHRPLPTDGDVAGVQITRRRIAGCYRLSIAITV
RLPEPTPALGGVPVSVTFGWAAAGDGAVHVARLGAPFGLGPPPPWLVKHLVAIPASATDVDVFAPAIWRLLLARDD
SIRGHRDDLLDGLREQVITALDEGVEVRLWPDDEDLLRSPVVARWRAPRRFVTLARAWPVEHPMAAMLEAWRLRDR TABLE 2-continued Amino Acid Sequences of Representative CLUST.018837 Effector Proteins*

HLWEYESHERDQVIARRRDAYRSVAAWICGQASEILLDYPPVAELRQVPDVNEEDEYVARAGRRQVQFAAPGDLRA
AIEVAARRRGVKVIDVRVPPE (SEQ ID NO: 157)

>3300006855|Ga0079044_1002244_2
[aquatic-thermal springs-hot spring]
MRVYRYGAKLRGPLDPVAEEQVELANRFWNELVDMHRKYGELLQKAQEEASPALAALRAEMAALAEEKIRLRGLIK
KSRQKARGNVPADPAIKEQLRAVSQRIKELKPIVKMEKEKAKTASSDERHRLSEQQKLEKKRLRQKYAALGLYWSN
YNAVLQGFDTAVKRELETQGRLRVRKHAPSGAAVWTVRIQHPTGAREYTWADATRGDPSKPFSIIMPDSEREEFTT
HDGRTLSRRRLPVARLRVAERAKTPDGTWVEFGGHHIDVPFYMHRQPPPTARVVMARLVRKRIADCYEYHLCITV
DEPPAPKRSGTAAGVDLGWRRLPDGAVRVAYVAGEDGAKGALAVPQSTLDRLAHAERLQGIRDSALEGIRSDFVAW
AKPLLGNPALPDFVAAALAGDREHGIPPLASWRSPRRFARLTGQLVRWAADHPNQAAALPDWPAWNRRIQSWNRQD
KPLWRTLSFLRVKAIAHRNEQYRIFAKRLAERYAYIVLEDMDIQDMNRKPQAEQAPETSQQKLRHLARAAAPAAVR
SAIENASWRWGSTFVKVDPANTTRRHAPCGNLVEQNYAESVMVYCPECKVWYDQDENAAVNLLLRIRENPPPAPTN
PKPANGSRWQRAKAKAR (SEQ ID NO: 158)

>3300006855|Ga0079044_1002244_2
[aquatic-thermal springs-hot spring]
MGPPAEAPGPRRDTAHSTEEEIASMRVYRYGAKLRGPLDPVAEEQVELANRFWNELVDMHRKYGELLQKAQEEASP
ALAALRAEMAALAEEKIRLRGLIKKSRQKARGNVPADPAIKEQLRAVSQRIKELKPIVKMEKEKAKTASSDERHRL
SEQQKLEKKRLRQKYAALGLYWSNYNAVLQGFDTAVKRELETQGRLRVRKHAPSGAAVWTVRIQHPTGAREYTWAD
ATRGDPSKPFSIIMPDSEREEFTTHDGRTLSRRRLPVARLRVAERAKTPDGTWVEFGGHHIDVPFYMHRQPPPTA
RVVMARLVRKRIADCYEYHLCITVDEPPAPKRSGTAAGVDLGWRRLPDGAVRVAYVAGEDGAKGALAVPQSTLDRL
AHAERLQGIRDSALEGIRSDFVAWAKPLLGNPALPDFVAAALAGDREHGIPPLASWRSPRRFARLTGQLVRWAADH
PNQAAALPDWPAWNRRIQSWNRQDKPLWRTLSFLRVKAIAHRNEQYRIFAKRLAERYAYIVLEDMDIQDMNRKPQA
EQAPETSQQKLRHLARAAAPAAVRSAIENASWRWGSTFVKVDPANTTRRHAPCGNLVEQNYAESVMVYCPECKVWY
DQDENAAVNLLLRIRENPPPAPTNPKPANGSRWQRAKAKAR (SEQ ID NO: 159)

>3300009503|Ga0123519_10000481_19
[aquatic-thermal springs-hot spring]
MRQLRVAHEVYNTLVQYERERRKAVADATRETDAEVARLEAEVEGLLSRLADLRAAIQAARAGGGDNARLAEAQAE
ARECRRLLGEAKGALRETKRVARQNPALRERLEAIKAEHHRRQLALYHEVVEVGKRLYWPSWNDTKAAVEQAAKKT
KNGDLRFRRWTGEGSLYTQVQGKQPVCETATSRWVRIDPVPPEAHDPATPRGERRRLCRTRFYLRIGSTGPREDPV
FAVFPMVYHRPLPEGAVICGARIVRRKNADREYWQAVVTVDLPDEAAQKSGPRVCALDIGWRDRRPGGSDEPPPLR
VAAWYDGDRTGEVLVDPSVFERCAKADAIRSTRDRMLDDLRAWLCEARKDLPEHLAEALAGCGLWRAAGKFARLRG
LLSSGDVPAEVRDRFLAWYHRDRHLWQYEHGMRLNAIRDRDNAYRIAAKRFAQEYDVLIVEATGTPQKERDPKAPA
AMDLRPLIKEPDPEDAPPRDQQRERKENKAHHQRFIAAAGTFRRYLLEAAAKYGTRVVMVPCEQTTLECWVCGAKY
EFDRWPLMHECESCGTTWDQDQNAARNLFARGAVAAKGPGPLEVQGKPRLPRWHKRHKAYREGGAG (SEQ ID
NO: 160)

>3300009503|Ga0123519_10000481_22
[aquatic-thermal springs-hot spring]
MATRNCRYGLLAPVEGRDEVMRQLRVAHEVYNTLVQYERERRKAVADATRETDAEVARLEAEVEGLLSRLADLRAA
IQAARAGGGDNARLAEAQAEARECRRLLGEAKGALRETKRVARQNPALRERLEAIKAEHHRRQLALYHEVVEVGKR
LYWPSWNDTKAAVEQAAKKTKNGDLRFRRWTGEGSLYTQVQGKQPVCETATSRWVRIDPVPPEAHDPATPRGERRR
LCRTRFYLRIGSTGPREDPVFAVFPMVYHRPLPEGAVICGARIVRRKNADREYWQAVVTVDLPDEAAQKSGPRVCA
LDIGWRDRRPGGSDEPPPLRVAAWYDGDRTGEVLVDPSVFERCAKADAIRSTRDRMLDDLRAWLCEARKDLPEHLA
EALAGCGLWRAAGKFARLRGLLSSGDVPAEVRDRFLAWYHRDRHLWQYEHGMRLNAIRDRDNAYRIAAKRFAQEYD
VLIVEATGTPQKERDPKAPAAMDLRPLIKEPDPEDAPPRDQQRERKENKAHHQRFIAAAGTFRRYLLEAAAKYGTR
VVMVPCEQTTLECWVCGAKYEFDRWPLMHECESCGTTWDQDQNAARNLFARGAVAAKGPGPLEVQGKPRLPRWHKR
HKAYREGGAG (SEQ ID NO: 161)

>3300006865|Ga0073934_10032691_1
[aquatic-thermal springs-hot spring sediment]
MFGHESLPSRIYSYGTMKLGDFPGRDKAEEQMRLAHRYRNRLVEIELARRRAVEEALRRLSPDLVGCELAIEAQER
ALEVARSSIRRASAEARKKVASPEARDAAKTAIAHLKRERAKRMSLRKALFSSSDWEAEEKRISDEAGAAIRKARA
ECGLYWGTYLHVEGTVKRTGAPPREHRWDGSGHLAVQIQHGMTWAEALAGADNRLRVRHAPPTNSKHSQLLHVVSV
RVGSTEDGFPVWADVPRVVLHRPIPDGARIKWVHLIRRRIGCSQKWHVQFVVSAESWERTDRATSGTVGINVGWRM
RPDGSLRVAAFCGDDGRRGELCLPSRWLAQWKKTEDIRSIRDRNFDDVRTAIANWVKGTIPEHVRALTGEVMPELP
PWWRQRAATLASWKSPARLAALTLHWRANRFAGDAVMFPLVEDWRRRDRHLYEYERHLADQLLAEREDLYRVFAAD
LRRRYKTAIVMELDLRDFHVLPPAEEPTPDGALREHTRDACLSLLHRCLDESMSEVIRSDPRNVTRMCRECGGLND
WDRKVLHRVCSWCHAEWDQDENAARNLRDRTGGGASDKVA (SEQ ID NO: 162)

>3300001340|JG120133J14441_1002607_2
[aquatic-thermal springs-hypersaline mat]
MPFGKKRSDKVAIVYEYGCLPPEGGLPAVAERQLVLADDEWNSLADIDRRHRAKMREILDDGELGKLNAHITSCKA
RIEELRGQIKGVNQRERRNAGVDANTKAEIARLKAEVKATAARIKEIKPEHIAKQKPLLEENDALRQAAVKRARQW
FSDRGLYWGTYNAVLRSYETAHKVLLKSGEQMQAHRYTGEGRWVVQIITTAGEKPTTAEDLATGTMVQIDPVDFSD
WKHISRGERRRRARTKCRIRVGSEGRAPVWLELPCVMHRPLPEGAEIVGADVTRRLVGPARWEYRLHLTLRVPAPV
PADAAKPAIGVDIGWRALPNGGTRVAYAVGEDGSRKEVVCPDDILAGLAKSSDLRSLRDEKMNRIKAFLRDVIPGL
DSADLSEQTEHLAMWKSPKRLIRLYRWWKEHRVEGDTEAFGRLHEWYYHDYWHLYQYEDDMRQQVLARRRDMYRIA
AKEIAERASVVVIEEFDLRKFAQEDQPEDGEDNKIQRARRVAVAPSEFRIALRQACAARGVRVVEKPAQNTTRVHV
VCGQVVAADYAADVTVRCPRCGVAYDQDANAALNLLGAGRGESTPAAS (SEQ ID NO: 163)

>3300009784|Ga0123357_10000018_105
[arthropoda-digestive system-termite gut]
MITVQYGVWHKWMRDVPRDVMDQLWLSHCVREDFVSTTLAYDARLKEIWSSFPVVGEAECRLLEASDALDVLLEE
QRVVRQSSRSKKVSADLRSRLADARGVVRAARVGRRDAIQVAKDAAMPLIVQAKDAQREARRGLYAKYCSYGVPDR
DGRVIRLYHATENDVRVMHEAAEKRLASSRKQGGRGQMRHHRFDGTGTLCVSLLRTAGDPPRTPMVVANSESGAYR TABLE 2-continued Amino Acid Sequences of Representative CLUST.018837 Effector Proteins*

NVLGVPWVAPVVWEGLSRSQRRADGRVGVRMRVGYGDDLKSPTHVDIPVQAHRFLPAEADITGAKLSIRRRGTKLI
GSLSITAKDVPDPLPVKDGPSIVLHWGWRDVPTGGAEVARWVSTSPLDIPVDMRGVFTCHDESRMSGAVIAPAVMF
TKLDHVEALQSELDTAFNEARGVLSEWLRAHPDVVVDDPTSREPVVLTGAVVGAWRSHERLARLAWAWHRECPAGV
EDMESVLWEWRCGHRHVSNIAANTRARAINARRDVYRNVAAVISGQCGGVGVDDMDLARLASRGASSELPDTVTAP
GSRRRVYAAPGELRYCIVSACQKDGVTVVTLDTAENSHTCHACGYANPGDDRWLNPMVLCDGCGKVFDQNTNALLN
LVDKYTATLAV (SEQ ID NO: 164)

>3300009784|Ga0123357_10000074_42
[arthropoda-digestive system-termite gut]
MVVAPPPVCDLRGNIPWILSWIIDEPAMLGMLLALYAGTLSEMIRVYRYGLLAPTMNGKLVKEQMRAAHRYRNALI
EIECARRDALRRLLTESGLRELEEETAAANEAVHAAAAAAREARMTVQSKSEPIDARQRMRDAREVSRRALDALRV
RRREVRENHAVQRAMDEINERAARLRRGARALCGVYWGTYLLVEDADHRARAAALYDGAQPNNPRCSRFVGAGRVG
VQIQKGFPCETLFGSDARLRVAPVDSGAWHSMRRGERRQLSRTTLSLRIGSEGRDPIWAQWPMLMHRPLPEGSIVK
RATVSVRRRGPRDEWAVEITVDVADEILAVQRTDSNESAVAIHIGWRAIGNELRVAAWAGSDGRSGELRLPASLLG
AFAKVEELRSIRDRNLAAARDALSGWLAAAASIPEWLREATVGIMEWRVPSRLAVLAKQWRNVRFVGDEKAYEALE
AWRYHDYHLWSWEDSQRIHALRARRELYRIFAAQLAREYVSIVIEDFDLRVVAKRHLVEDASIEWRGLRRNRQAAA
VSELRASLQNASKSRSARIELLDTRSFLQPCHACGSKERFDSVEPLDHSCSGCGAIWDRDSNAALVLLQRWRREHA
CGGEVAHADVDTKPVPEGRWVRARRHRAEKDAHARFGASDNSEWFGNGNASVISIESPS (SEQ ID NO: 165)

>3300009784|Ga0123357_10000076_32
[arthropoda-digestive system-termite gut]
MITVIKYGVWHTWSRHIPDSVRDQLWLAHCAREDLVTTTLDYHDALKDIWSSFPEVAAAEQRIRDADDLLATLLDE
QSKARQASQSKKVPTDLRQRLTQARASVRSAKQERRDAITTAGVIATPLIAQAKDAQYARRKELYTTYCTRGIPDR
DGRIVRLYHATENDVRTSHETAEKRISASRANGSPAQMRHHRFDETGTLAVSLLRQAGAPPRTPQVLADTETGKYR
NVLAMPWFTPDAWAGKTRAQQRVDGRVTLRMRIGYADDLSSPTFVDLPVQAHRFFPPEADITGAKLTIQRRGTTFH
ATVSITGKGLPDPTPVTSGPAVVLHWGWREVDTDIVEVARWAADAPLHIPDDMGDVFTTDGSGTGGSILTPKTVFT
RLNHVEKLQSEQGTAFSSAKNALVSWLSTHATPMGDPTSKQPQPLAPALVDAWRSPDRLARLAWLWRDDRPDGADD
LTADLLAWRGAYRHTATLIANTRAKAISHRNDVYRNVAAVISGQAATVGLDSMDLATIAATSARSELSGDVTQPGA
RRRTYAAPGTLREYIAAACAKDGVTVSSLDSSHASRTHYECGHTNPRDTKWLNPIVRCDGCGESFDQNTNALHHLQ
ARQRDLSLTA (SEQ ID NO: 166)

>BBPF01004549_6
[groundwater metagenome]
MPFGRKAKPCRVFEYGCLPPVSGKDELLKELRLRNNYWNKLVEIDRLIRQRSALILLLPGDIEAAHLDAQIDLMRG
EIKKGRQRTRSSITDADLKQRIKDSIAELRVLWEQNKKDRKPLIETTRADLAAIETEWRVARKAARADSGLYWCNY
DDVDTAYDVARKETAKKWAFPKERREDGTGKVTVRWQNGLNANNVEDGTGTLLQIAPVHQDAWNHPVRSNRRKASR
TTVRERVRSENRSPVWVELPMVMHRPLPAGGEIRSASLVCGYVGGKPTYKLVITVAPPAHTLPEEGMHRGIRPTVG
INLGWRKKDNDIRIAYWADEEGRHGELTLTSNTLAQFSKLNDLKSIRDKYFNEAISALALYISEGTIPDWLKADTT
HLNKWRSKPRLLALVGKWRETRFTGDEIIYEALFYWRGRELHLHQWEANLRDQVQRHRRERYRIFAAQLAKDYSQI
FIENHNLVVTKKKKATEDGTYLTTEVDTLRTIASPGILRGQIENACRREGVIFTKLDAKHITSKCHICGWQEKWNA
AATITRECPGCKTEWDQDYNAARLLLQRGLDGGYLAVPQTTLEDDPNECIGS (SEQ ID NO: 167)

>BBPG01001333_4
[groundwater metagenome]
MPFGRKAKPCRVFEYGCLPPVSGKDELLKELRLRNNYWNKLVEIDRLIRQRSALILLLPGDIEAAHLDAQIDLMRG
EIKKGRQRTRSSITDADLKQRIKDSIAELRVLWEQNKKDRKPLIETTRADLAAIETEWRVARKAARADSGLYWCNY
DDVDTAYDVARKETAKKWAFPKERREDGTGKVTVRWQNGLNANNVEDGTGTLLQIAPVHQDAWNHPVRSNRRKASR
TTVRERVRSENRSPVWVELPMVMHRPLPAGGEIRSASLVCGYVGGKPTYKLVITVAPPAHTLPEEGMHRGIRPTVG
INLGWRKKDNDIRIAYWADEEGRHGELTLTSNTLAQFSKLNDLKSIRDKYFNEAISALALYISEGTIPDWLKADTT
HLNKWRSKPRLLALVGKWRETRFTGDEIIYEALFYWRGRELHLHQWEANLRDQVQRHRRERYRIFAAQLAKDYSQI
FIENHNLVVTKKKKATEDGTYLTTEVDTLRTIASPGILRGQIENACRREGVIFTKLDAKHITSKCHICGWQEKWNA
AATITRECPGCKTEWDQDYNAARLLLQRGLDGGYLAVPQTTLEDDPNECIGS (SEQ ID NO: 167)

>OGZV01009429_1
[human gut metagenome]
MNKVSITKVEKYRCEEPVEGLALFDEALDNRHTLWNKLVEIDRDFREKSTQIITPIKSDYQVLDQEIKNLQDSIKA
IKRKTRSTAKEETRNIQDTIKELKVKRKEAYQEFKRLKHEAIEREKPLLDCLNNEREKEVKQLRSESGLHGENFDD
VIHNIYDVARIKAMKQGTLLQFKRYSKNGKIAVRPYSSSPLYGSDIHRVNTIFYIEPVNQELYNSPIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTICGLSSTRQKHLNDCIHVIKAWMANKNLPDWLTDAVAYIDK
WKSYTHIFDLHSAFLQHKKSGNQEIVSYLEAYIERENHLRTWQSNLQNQVIARRNYEYQNFAAKLANMYDVLVLEK
LSITNIVKHQKAIIGSQQSTAVDRNRTIVAPYVLKTILINAFRSRGKQFVEVNASYSTKVCHHCGALEEVHQSSIM
HTCTQCHTVWDQDYNACINLLALYNHDNKGGVSCV (SEQ ID NO: 168)

>OKWZ01000119_10
[human gut metagenome]
MNKVSITKVEKYRCEEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNEREKEVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQATAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

TABLE 2-continued

Amino Acid Sequences of Representative CLUST.018837 Effector Proteins*

>ODGRO1000476_16
[human metagenome]
MNKVSITKVEKYRCEEPVEGLALFDEALDNRHTLWNKLVEIDRDFREKSSQIITPIQSDYQVLDQEIKNLQDSIKA
IKRKTRSTAKEETRNIQDTIKELKVKRKEAYQEFKRLKHEAIEREKPLLDCLNNERKEKVKQLRSESGLHGENFDD
VIHNIYDVARIKAMKQGTLLQFKRYSKNGKIAVRPYSSSPLYGSDIHRVNTIFYIEPVNQELYNSPIRGVRKKASV
TRCHIRVGSADKGKPIFVTLPMVYHRPLPMDGKINAINVKRHYFDHKPIYECLITVTYAIEAPTINPNSCVAVDLG
WRMTKDGLRAAYATDTDDKTIECIVTQRQLNEFDTICGLSSTRQKHLNDCIHVIKAWMANKNLPDWLTDAVAYIDK
WKSYTHIFDLHSAFLQHKKSGNQEIVSYLEAYIERENHLRTWQSNLQNQVIARRNYEYQNFAAKLANMYDVLVLEK
LSITDIVKHQKAMIGSQQSTALDRNRTIVAPYELKTILINAFTNRGKQFVEVNASYSTKVCHHCGALEEVHQSSTM
HTCTQCHTVWDQDYNACINLLALYNHNNKVGVSCV (SEQ ID NO: 170)

>ODIG01000268_14
[human metagenome]
MNKVSITKVEKYRCEEPVEGLSLEDEALDNRHMLWNKLVEIDRDFREKSSKIITPIQSDYQVLDQEIKNLQDAVKA
IKCKTRSTAKEETRTIQDTIKELKVKRKEAYQEFKRLKHEATEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIEVTLPMVYHRPLPMDGKINAINIKRHYIDQKPIYECEITVTYLIEAPAVNPNSCVAVDLG
WRMTKDGLRAAYATDKDHKATECIVTQRQLNEFDTIRGLSSTRQKHENDCIHVIKAWIANKNLPDWLIDAVAYIDK
WKSYTHIFKLYNAFLQHEKSGNQEITSYLEAYIERENHLRIWQSNLQDQATAKRNYEYQNFAARLANMYDVLVLEK
LSITDIVKYQKATIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>ODIP01002140_2
[human metagenome]
MNKVSITKVEKYRCEEPVEGLALFDEALDNRHMLWNKLVEIDRNFREKSSQIITPIQSDYQVLDQEIKNLQDSIKA
IKRKTRSTAKEETRNIQDTIKELKVKRKEAYQEFKRLKHEATEREKPLLDCLNNERKEQVKQLRSKSGLHGENFDD
VIHNIYDVARVKAMKQGTLLRFKRYSKNGKIAVRPYSNSPLYGADIHRVNTIFYIEPVNQELYNSPIRGVRKKASV
TQCHIRVGSADKGKPIEVTLPMVYHRPLPMDGKINAINVKRHYIDHKPIYECLITVTYVIEAPAVNPSSCVAVDLG
WRMTKDGLRAAYATDKDNKTMECIVAQRQLNEFDTIRGLSSTRQKHENDCIHVIKAWIANKNLPDWLIDAVAYIDK
WKSYTHIFELYNAFLQHEKSGNQEIVSYLEAYIERENHLRIWQSNLQDQVIAKRNYEYQNFAAKLANMYDVLVIEK
LSITDIVKHQKATIGSQQSTALDRNRTIVAPYVLKTILINAFTSRGKQFVEVNASYSTKVCHHCGALEEVHQSSIM
HTCTQCHTIWDQDYNACINLLTLYNHDNKVGVSCV (SEQ ID NO: 171)

>ODIW01000227_18
[human metagenome]
MNKVSITKVEKYRCEEPVEGLALFDEALDNRHMLWNKLVEIDRNFREKSSQIITPIQSDYQVLDQEIKNLQDSIKA
IKRKTRSTAKEETRNIQDTIKELKVKRKEAYQEFKRLKHEATEREKPLLDCLNNERKEQVKQLRSKSGLHGENFDD
VIHNIYDVARVKAMKQGTLLRFKRYSKNGKIAVRPYSNSPLYGADIHRVNTIFYIEPVNQELYNSPIRGVRKKASV
TQCHIRVGSADKGKPIEVTLPMVYHRPLPMDGKINAINVKRHYIDHKPIYECLITVTYVIEAPAVNPSSCVAVDLG
WRMTKDGLRAAYATDKDNKTMECIVAQRQLNEFDTIRGLSSTRQKHENDCIHVIKAWIANKNLPDWLIDAVAYIDK
WKSYTHIFELYNAFLQHEKSGNQEIVSYLEAYIERENHLRIWQSNLQDQVIAKRNYEYQNFAAKLANMYDVLVIEK
LSITDIVKHQKATIGSQQSTALDRNRTIVAPYVLKTILINAFTSRGKQFVEVNASYSTKVCHHCGALEEVHQSSIM
HTCTQCHTIWDQDYNACINLLTLYNHDNKVGVSCV (SEQ ID NO: 171)

>ODJA01000260_38
[human metagenome]
MNKVSITKVEKYRCEEPVEGLSLEDEALDNRHMLWNKLVEIDRDFREKSSKIITPIQSDYQVLDQEIKNLQDAVKA
IKCKTRSTAKEETRTIQDTIKELKVKRKEAYQEFKRLKHEATEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIEVTLPMVYHRPLPMDGKINAINIKRHYIDQKPIYECEITVTYLIEAPAVNPNSCVAVDLG
WRMTKDGLRAAYATDKDHKATECIVTQRQLNEFDTIRGLSSTRQKHENDCIHVIKAWIANKNLPDWLIDAVAYIDK
WKSYTHIFKLYNAFLQHEKSGNQEITSYLEAYIERENHLRIWQSNLQDQATAKRNYEYQNFAARLANMYDVLVLEK
LSITDIVKYQKATIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>ODJP01000229_55
[human metagenome]
MNKVSITKVEKYRCEEPVEGLSLEDEALDNRHMLWNKLVEIDRDFREKSSKIITPIQSDYQVLDQEIKNLQDAVKA
IKCKTRSTAKEETRTIQDTIKELKVKRKEAYQEFKRLKHEATEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIEVTLPMVYHRPLPMDGKINAINIKRHYIDQKPIYECEITVTYLIEAPAVNPNSCVAVDLG
WRMTKDGLRAAYATDKDHKATECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQATAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>ODKZ01007116_1
[human metagenome]
MNKVSITKVEKYRCEEPVEGLALFDEALDNRHTLWNKLVEIDRNFREKSSQIITPIQSDYQVLDQEIKNLQDSIKA
IKRKTRSTAKEETRNIQDTIKELKVKRKEAYQEFKRLKHEAIEREKPLLDCLNNERKEKVKQLRSESGLHGENFDD
VIHNIYDVARIKAMKQGTLLQFKRYSKNGKIAVRPYSSSPLYGSDIHRVNTIFYIEPVNQELYNSPIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTICGLSSTRQKHLNDCIHVIKAWMANKNLPDWLTDAVAYIDK
WKSYTHIFDLHSAFLQHKKSGNQEIVSYLEAYIERENHLRTWQSNLQNQVIARRNYEYQNFASKLANMYDVLVLEK
LSITDIVKHQKAMIGSQQSTALDRNRTIVAPYELKTILINAFTNRGKQFVEVNASYSTKVCHHCGALEEVHQSSTM
HTCTQCHTVWDQDYNACINLLALYNHNNKVGVSCV (SEQ ID NO: 172)

TABLE 2-continued

Amino Acid Sequences of Representative CLUST.018837 Effector Proteins*

>ODM001000523_12
[human metagenome]
MNKVSITKVEKYRCEEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQATAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>ODTN01000195_35
[human metagenome]
MNKVSITKVEKYRCEEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQATAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>ODTP01000194_18
[human metagenome]
MNKVSITKVEKYRCEEPVEGLALFDEALDNRHTLWNKLVEIDRNFREKSSQIITPIQSDYQVLDQEIKNLQDSIKA
IKRKTRSTAKEETRNIQDTIKELKVKRKEAYQEFKRLKHEAIEREKPLLDCLNNERKEKVKQLRSESGLHGENFDD
VIHNIYDVARIKAMKQGTLLQFKRYSKNGKIAVRPYSSSPLYGSDIHRVNTIFYIEPVNQELYNSPIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTICGLSSTRQKHLNDCIHVIKAWMANKNLPDWLTDAVAYIDK
WKSYTHIFDLHSAFLQHKKSGNQEIVSYLEAYIERENHLRTWQSNLQNQVIARRNYEYQNFASKLANMYDVLVLEK
LSITDIVKHQKAMIGSQQSTALDRNRTIVAPYELKTILINAFTNRGKQFVEVNASYSTKVCHHCGALEEVHQSSIM
HTCTQCHTVWDQDYNACINLLALYNHNNKVGVSCV (SEQ ID NO: 172)

>ODWI01002981_3
[human metagenome]
MNKVSITKVEKYRCEEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQATAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>ODZZ01005262_2
[human metagenome]
MNKVSITKVFKYRCFEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQAIAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>OEED01000500_25
[human metagenome]
MNKVSITKVFKYRCFEPVEGLALFDEALDNRHMLWNKLVEIDRNFREKSSQIITPIQSDYQVLDQKIKNLQDSIKA
IKRKTRSTAKEETRNIQDTIKELKVKRKEAYQEFKRLKHEAIEREKPLLDCLNNERKEQVKQLRSKSGLHGENFDD
VIHNIYDVARVKAMKQGTLLRFKRYSKNGKIAVRPYSNSPLYGADIHRVNTIFYIEPVNQELYNSPIRGVRKKASV
TQCHIRVGSADKGKPIFVTLPMVYHRPLPMDGKINAINVKRHYIDHKPIYECLITVTYVIEAPAVNPSSCVAVDLG
WRMTKDGLRAAYATDKDNKTMECIVAQRQLNEFDTIRGLSSTRQKHENDCIHVIKAWIANKNLPDWLIDAVAYIDK
WKSYTHIFELYNAFLQHEKSGNQEIVSYLEAYIERENHLRIWQSNLQDQVIARKNYEYQNFAAKLANMYDVLVIEK
LSITDIVKHQKAIIGSQQSTALDRNRTIVAPYVLKTILINAFTSRGKQFVEVNASYSTKVCHHCGALEEVHQSSIM
HTCTQCHTIWDQDYNACINLLALYNHDNKVGVSCV (SEQ ID NO: 173)

>OEFT01000529_3
[human metagenome]
MNKVSITKVFKYRCFEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQAIAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

TABLE 2-continued

Amino Acid Sequences of Representative CLUST.018837 Effector Proteins*

>LAZR01002400_15
[marine sediment metagenome]
MNLGRVYYNSLVEAENERRTTMWGGDRPPSPATHVCKKSCSTCDKAESKKRKPRKHECKKFCPVCRAHYKALRKQY
RSEPPLDVKPFRKKAAEGGLYWGTYLVIEQDFSAAWKETESFSLVKFRSWRQGDMCAVQIQRDKDPDRMFLIKSAP
DPRKKKQQRYTLRLRVGSKGQAPVWAEPLPFEMHRPLQGTATWVKIARKYVADRVIWSVQFTRRDIPERKDNAERG
AVAIDVGWRKTDDGMRIAYARGDDGAEYELVLPPKWMKHADQADRIRSARDQNLVELQKQERFWSVILAVCGFSNK
KLFARLKSTLSVRRVAKPGEHTKWIKKERHLWQYEAGCRNRSVTRRRNDVRVWLRDLRRRYAHAVIKDSCHKKMKE
NKTSLPKPARRQGHHAAPGEVIEEITRVFGRITGVSVVCAVDTTNHCPACSFVNSYGPERVVTCGGCGVVEDRDRV
STQNMMNMYAIGNVRNPTTRKSTPRFAKKHKDPEAP (SEQ ID NO: 174)

>LAZR01002400_19
[marine sediment metagenome]
MTKVYKYGALPGGDTLCAQMNLGRVYYNSLVEAENERRTTMWGGDRPPSPATHVCKKSCSTCDKAESKKRKPRKHE
CKKFCPVCRAHYKALRKQYRSEPPLDVKPFRKKAAEGGLYWGTYLVIEQDFSAAWKETESFSLVKFRSWRQGDMCA
VQIQRDKDPDRMFLIKSAPDPRKKKQQRYTLRLRVGSKGQAPVWAEPLPFEMHRPLQGTATWVKIARKYVADRVIW
SVQFTRRDIPERKDNAERGAVAIDVGWRKTDDGMRIAYARGDDGAEYELVLPPKWMKHADQADRIRSARDQNLVEL
QKQERFWSVILAVCGFSNKKLFARLKSTLSVRRVAKPGEHTKWIKKERHLWQYEAGCRNRSVTRRRNDVRVWLRDL
RRRYAHAVIKDSCHKKMKENKTSLPKPARRQGHHAAPGEVIEEITRVFGRITGVSVVCAVDTTNHCPACSFVNSYG
PERVVTCGGCGVVEDRDRVSTQNMMNMYAIGNVRNPTTRKSTPRFAKKHKDPEAP (SEQ ID NO: 175)

>FLSK01003024_2
[metagenome]
MNKVSITKVFKYRCFEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNEREKEVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQAIAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>OFLM01000072_9
[metagenome]
MNKVSITKVFKYRCFEPVEGLALFDEALDNRHTLWNQLVEIDRNFREKSSQIITPIQSDYQVLDQEIKNLQDSIKA
IKRKTRSTAKEETRIIKDTIKELKVKRKEAYQEFKRLKHEAIEREKPLLDCLNNERKEQVKQLRSKSGLHGENFDD
VIHNIYDVARVKAMKQGTLLRFKRYSKNGKIAVRPYSNSPLYGADIHKVNTIFYIEPVNQELYNSPIRGVRKKASV
TQCHIRVGSADKGKPIFVTLPMVYHRPLPMDGKINAINVKRHYIDHKPIYECLITVTYVIEAPAVNPSSCVAVDLG
WRMTKDGLRAAYATDKDNKTMECIVAQRQLNEFDTIRGLSSTRQKHENDCIHVIKAWIANKNLPDWLIDAVAYIDK
WKSYTHIFELYNAFLQHEKSGNQEIVSYLEAYIERENHLRIWQSNLQDQVIAKRNYEYQNFAAKLANMYDVLVIEK
LSITDIVKHQKAIIGSQQSTALDRNRTIVAPYVLKTILINAFTSRGKQFVEVNASYSTKVCHHCGALEEVHQSSIM
HTCTQCHTIWDQDYNACINLLALYNHDNKVGSCV (SEQ ID NO: 176)

>OFL001000090_50
[metagenome]
MNKVSITKVFKYRCFEPVEGLALFDEALDNRHTLWNQLVEIDRNFREKSSQIITPIQSDYQVLDQEIKNLQDSIKA
IKRKTRSTAKEETRIIKDTIKELKVKRKEAYQEFKRLKHEAIEREKPLLDCLNNERKEQVKQLRSKSGLHGENFDD
VIHNIYDVARVKAMKQGTLLRFKRYSKNGKIAVRPYSNSPLYGADIHKVNTIFYIEPVNQELYNSPIRGVRKKASV
TQCHIRVGSADKGKPIFVTLPMVYHRPLPMDGKINAINVKRHYIDHKPIYECLITVTYVIEAPAVNPSSCVAVDLG
WRMTKDGLRAAYATDKDNKTMECIVAQRQLNEFDTIRGLSSTRQKHENDCIHVIKAWIANKNLPDWLIDAVAYIDK
WKSYTHIFELYNAFLQHEKSGNQEIVSYLEAYIERENHLRIWQSNLQDQVIAKRNYEYQNFAAKLANMYDVLVIEK
LSITDIVKHQKAIIGSQQSTALDRNRTIVAPYVLKTILINAFTSRGKQFVEVNASYSTKVCHHCGALEEVHQSSIM
HTCTQCHTIWDQDYNACINLLALYNHDNKVGSCV (SEQ ID NO: 176)

>OFLU01000140_22
[metagenome]
MNKVSITKVFKYRCFEPVEGLALFDEALDNRHTLWNKLVEIDRDFREKSSQIITPIQSDYQVLDQEIKNLQDSIKA
IKRKTRSTAKEETRNIQDTIKELKVKRKEAYQEFKRLKHEAIEREKPLLDCLNNEREKEVKQLRSESGLHGENFDD
VIHNIYDVARIKAMKQGTLLQFKRYSKNGKIAVRPYSSSPLYGSDIHRANTIFYIEPVNQELYNSSIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTIRGLSSTRQKHENDCIHVIKAWMANKNLPDWLTDAVTYIDK
WKSYKHIFELHDAFLQHKKSGNQEIVSYLEAYIERENHLRTWQSNLQDQVIARRNYEYQNFAAKLANMYDVLVLEK
LSITDIVKHQKAIIGSQQSTALDRNRTIVAPYELKKILINAFTNRGKQFVEVNASYSTKVCHHCGALEEVHQSSIM
HTCTQCHTVWDQDYNACINLLALYNHDNKVGSYV (SEQ ID NO: 177)

>OFLV01000230_3
[metagenome]
MNKVSITKVFKYRCFEPVEGLALFDEALDNRHTLWNKLVEIDRDFREKSSQIITPIQSDYQVLDQEIKNLQDSIKA
IKRKTRSTAKEETRNIQDTIKELKVKRKEAYQEFKRLKHEAIEREKPLLDCLNNEREKEVKQLRSESGLHGENFDD
VIHNIYDVARIKAMKQGTLLQFKRYSKNGKIAVRPYSSSPLYGSDIHRANTIFYIEPVNQELYNSSIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTIRGLSSTRQKHENDCIHVIKAWMANKNLPDWLTDAVTYIDK
WKSYKHIFELHDAFLQHKKSGNQEIVSYLEAYIERENHLRTWQSNLQDQVIARRNYEYQNFAAKLANMYDVLVLEK
LSITDIVKHQKAIIGSQQSTALDRNRTIVAPYELKKILINAFTNRGKQFVEVNASYSTKVCHHCGALEEVHQSSIM
HTCTQCHTVWDQDYNACINLLALYNHDNKVGSYV (SEQ ID NO: 177)

TABLE 2-continued

Amino Acid Sequences of Representative CLUST.018837 Effector Proteins*

>OGCY01000078_30
[metagenome]
MNKVSITKVFKYRCFEPFEGLELFNEALDNRHTLWNKLVEIDRDFREKSSQIITPIQSEYQILDQEIKNLQDSIKA
IKRETRSTAKEETRNIQDTIKELKVKRKEAYQEFKRLKHEAIEREKPLLDCLNNERKEKVKQLRSESGLHGENFDD
VIHNIYDVARIKAMKQGTLLQFKRYSKNGKIAVRPYSSSPLYGSDIHRVNTIFYIEPVNQELYNSSIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTIRGLSSTRQKHENDCIHVIKAWMANKNLPDWLTDAVAYIDK
WKSYKHIFDLYDAFLQHKKSGNQEIVSYLEAYIERENHLRTWQSNLQDQVIARRNYEYQNFAAKLANMYDVLVLEK
LSITDIVKHQKAIIGSQQSTALDRNRTIVAPYELKTILINAFTNRGKQFVEVNASYSTKVCHHCGALEEVHQSSIM
HTCTQCHTVWDQDYNACINLLALYNHDNKVGVSYV (SEQ ID NO: 178)

>OGJ001000473_2
[metagenome]
MNKVSITKVFKYRCFEPVEGLSLFDEALDNRHMLWNKLVEIDRDFREKSSKIITPIQSDYQVLDQEIKNLQDAVKA
IKCKTRSTAKEETRTIQDTIKELKVKRKEAYQEFKRLKHEAIEREKPLLDCLNNERKEKVKQLRSKSGLHGENFDD
VTHNIYEVARVKAMKQGTLLRFKRYSKNGKIAVRPYSNSPLYGSDIHRVNTIFYIDPVNQELYNSPIRGVRKKASV
TQCHIRIGSAVKGKPIFVTLPMVYHRPLPMDGKINAINIKRHYIDQKPIYECFITVTYLIEAPAVNPNSCVAVDLG
WRMTKDGLRAAYATDKDHKAIECIVTQRQLNEFDTIRGLSSTRQKHENDCIHVIKAWIANKNLPDWLIDAVAYIDK
WKSYTHIFKLYNAFLQHEKSGNQEIISYLEAYIERENHLRIWQSNLQDQAIAKRNYEYQNFAARLANMYDVLVLEK
LSITDIVKYQKAIIGSQQSTALDRNRTIVAPYELKTILINAFTSRGKQFVEVNASYSTKVCHHCGALEEVHQSSIM
HTCTQCHTVWDQDYNACINLLALYDNKVGAY (SEQ ID NO: 169)

>OGJT01000109_37
[metagenome]
MNKVSITKVFKYRCFEPVEGLALFDEALDNRHTLWNKLVEIDRDFREKSTQIITPIQSDYQVLDQEIKNLQDSIKA
IKRKTRSTAKEETRNIQDTIKELKVKRKEAYQEFKRLKHEAIEREKPLLDCLNNERKETVKQLRSESGLHGENFDD
VIHNIYDVARIKAMKQGTLLQFKRYSKNGKIAVRPYSSSPLYGSDIHRINTIFYIEPVNQELYNSSIRGIRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTIRGLSSTRQKHENDCIHVIKAWMANKNLPDWLTDAVAYIDK
WKSYKHIFDLYDAFLQHKKSGNQEIVSYLESYIERENHLRTWQSNLQVQVIARRNYEYQNFAAKLANMYDVLVLEK
LSITDIVKHQKAIIGSQQSTALDRNRTIVAPYELKKILINAFTNRGKQFVEVNASYSTKVCHHCGALEEVHQSSIM
HTCTQCHTVWDQDYNACINLLALYNHDNKVGVSNV (SEQ ID NO: 179)

>OGJZ01005194_5
[metagenome]
MNKVSITKVFKYRCFEPVEGLALFDEALDNRHTLWNKLVEIDRDFREKSSQIITPIQSDYQVLDQEIKSLQDSIKA
IKRKTRSTAKEETRNIQDTIKELKVKRKEAYQEFKRLKHEAIEREKPLLDCLNNERKEKVKQLRSESGLHGENFDD
VIHNIYDVARIKAMKQGTLLRFKRYSKNGKIAVRPYSSSPLYGSDIHRVNTIFYIEPVNQELYNSSIRGVRKKASV
TRCHIRVGSADKGKPIFVTLPMVYHRPLPMDGKINAINVKRHYIDHKPIYECLITVTYAIKSPAVNPDSCVAVDLG
WRMTKDGLRAAYATDTDNKTMECIVAQRQLNEFDTIRGLSSTRQKHENDCIHVIKAWMANKNLPDWLTDAVAYIDK
WKSYKHIFDLYDAFLQHKKSGNQEIVSYLEAYIERENHLRIWQSNLQDQVIARRNYEYQNFAAKLANMYDVLVLEK
LSITDIVKHQKAIIGSQQSTALDRNRTIVAPYELKTILINAFTNRGKQFVEVNASYSTKVCHHCGALEEVHQSSIM
HTCTQCHTVWDQDYNACINLLALYNHDNKVGVSYV (SEQ ID NO: 180)

>OGKO01001669_8
[metagenome]
MNKVSITKVFKYRCFEPVEGLALFDEALDNRHTLWNKLVEIDRDFREKSSQIITPIQSDYQVLDQEIKNLQDSIKA
IKRKTRSTAKEETRNIQDTIKELKVKRKEAYQEFKRLKHEAIEREKPLLDCLNNERKEKVKQLRSESGLHGENFDD
VIHNIYDVARIKAMKQGTLLQFKRYSKNGKIAVRPYSSSPLYGSDIHRVNTIFYIESVNQELYNSPIRGVRKKASV
TRCHIRVGSADKGKPIFVTLPMVYHRPLPMDGKINAINVKRHYIDHKPIYECLITVTYAIEAPTINPNSCVAVDLG
WRMTKDGLRAAYATDTDDKTIECIVTQRQLNEFDTIRGLSSTRQKHENDCIHVIKAWMANKNLPDWLTDAVAYIDK
WKSYKHIFDLYDAFLQHKKSGNQEIVSYLEAYIERENHLRTWQSNLQDQVIARRNYEYQNFAAKLANMYDVLVLEK
LSITDIVKHQKAIIGSQQSTALDRNRTIVAPYELKKILINAFTNRGKQFVEVNASYSTKVCHHCGALEEVHQSSIM
HTCTQCHTVWDQDYNACINLLALYNHDNKVGVSYV (SEQ ID NO: 181)

>OFCI01000292_37
[metagenomes unclassified sequences.]
MWYAHRYGNVLVEIERARRAAVRLAYGPLATFEHAAKEAGTVVRDAREAIKRARAEHRARVETDAMKLALSSAREA
EREAKRALFEARRQLRESGAVDAALADIEARAGELRRGARALSGVHWGTYSLIEAAHDASRKMPLYDGVEPNDPRF
ARWEHEGQVGIQVHQKGSTGTGMVAEELHAGIGGEWLRVERVHDTRQGRRAGTRARLTMRIGTSDVDGTPIVAAWP
MVMHRAVPPGAIVRRATVSLRRRGPREEWSVELTIQVPSTIAPEERQGRVAINVGWRSMGDTIRVASWVGSDGQKG
ELHLSKRTIEGLRKPEGLRSTRDKNFNDARNALLLALAGLNVPEWYTLRAKALSQWRSPQRLAALATEWKTKRFAG
DESAYLALETWRYHDHHLWAWEASQSVGSHRHREVYRVFGSQLAKRYRTLVLADFDKRVVAIRPAVGDANDKTQN
ETARSNRQLASTSELEREAANAFTSRGGTAEYLSAVDITHTCADCGALSTFDAAERIHAACSSCGVVFDQDENAAR
VLCERWRDGEKVGVARVAEPQEKVGSKWQRAKARKEERQAARKAVASAAE (SEQ ID NO: 182)

>3300006048|Ga0075363_100000001_25
[plants-endosphere-populus endosphere]
MAFGNKSKPTRKYNYGCRGFLSGPREINPDGTKALRQRFDGHDLAVTQMKLAHQFQNKLVEIERARREAIDPILVR
HFPALTTLHNAAQEQQERLQELRDELSQSNSQNRQLMSDPELVEQINAQKRVVSQAWEFYSDQRDAAFADPKVKAD
LKDNDKSFEQRKADARNAAVEGGLYWATSLQVVGRVKRTGPPPKFKSWRGEEVISVQFQRKPDKTSPKEPVLDSKG
NPKIHPRSKKPTFAHVGGSSLRTCDVFTPNTNCWIERTYQPPLTAPHPKYVVIHFRVSSDEKGKPVMASIPAVMSR
PLPEDGEVKWVHLSRRKIGTHYRWDVQFDIARDAWTYHPAGQDRAQEGTVAVALGWRLIDGEIRVTEWVGDDGVTG
TVRIPKELVEGWSYLDTLQSIRDTLFEAERAELVDWFVNYPNPLPEEWTERAQTLIQWRSADRFMWLIWWWKDHRI
PGDEEIFQRMWGRIQLNPTTGRNQYTGGRLQSKHLCDWRAHKRDKIKNWRKDFFRKVAIDLSYQYKDVVIAEIDWN
KLAENPEVENGNDIVNKRYALSSCAQLRDEITRYMNEVTESARNIVTTCCQCGESCDHPKSGRWIRCESCGGEKR
DRAVNAATNLLNRALGASGAKVPARV (SEQ ID NO: 183)

TABLE 2-continued

Amino Acid Sequences of Representative CLUST.018837 Effector Proteins*

>3300006048|Ga0075363_100000001_20
[plants-endosphere-populus endosphere]
MVAAKISHLLEFPSMAFGNKSKPTRKYNYGCRGFLSGPREINPDGTKALRQRFDGHDLAVTQMKLAHQFQNKLVEI
ERARREAIDPILVRHFPALTTLHNAAQEQQERLQELRDELSQSNSQNRQLMSDPELVEQINAQKRVVSQAWEFYSD
QRDAAFADPKVKADLKDNDKSFEQRKADARNAAVEGGLYWATSLQVVGRVKRTGPPPKFKSWRGEEVISVQFQRKP
DKTSPKEPVLDSKGNPKIHPRSKKPTFAHVGGSSLRTCDVFTPNTNCWIERTYQPPLTAPHPKYVVIHFRVSSDEK
GKPVMASIPAVMSRPLPEDGEVKWVHLSRRKIGTHYRWDVQFDIARDAWTYHPAGQDRAQEGTVAVALGWRLIDGE
IRVTEWVGDDGVTGTVRIPKELVEGWSYLDTLQSIRDTLFEAERAELVDWFVNYPNPLPEEWTERAQTLIQWRSAD
RFMWLIWWWKDHRIPGDEEIFQRMWGRIQLNPTTGRNQYTGGRLQSKHLCDWRAHKRDKIKNWRKDFFRKVAIDLS
YQYKDVVIAEIDWNKLAENPEVENGNDIVNKRYRALSSCAQLRDEITRYMNEVTESARNIVTTCCQCGESCDHPKS
GRWIRCESCGGEKRDRAVNAATNLLNRALGASGAKVPARV (SEQ ID NO: 184)

>3300006048|Ga0075363_100000020_49
[plants-endosphere-populus endosphere]
MIVYKYGALKPKVIGGTFEDLLQYQRHSNAFYNALIEIERWRIAARDIVELAQSAPLSDEQKTEHRLAYNAACRAA
GAATPIGWGQKQAVTEMVAAAMKTRRSDEFKARQRASKKGYDFLKRVMTCARPRHRREDGEGILAATVQGATGLKA
SAVLTKPGPVQISGDGKHRTVTLRLREGLSLEVPIVYHRPLPERAEKEGVPYDVRVIFARLVIDRIGDRWTYSVHL
TIDAAPRVHVAQGGLGRCAVNFGWRRVPGGIRVAYAVDDDGNETSCVFPDALLGRQKHAESLRSLADEIAAAYLGD
AARRTKARCSALADPDAIHRELGREWFTMEQAAKRDGTDAEHWARRDRHLYQWERDEYASVLRARREIYRLWARKL
AASYDSVIIEAFDMRSVVKRTPSEDDIPAARHYRFLVGPHCLRLEIQSVFGARCEVLKPAKRTLTCHACGALCKWD
KARELRHDCESCGAAWDQDANNAKNQLLDAAE (SEQ ID NO: 185)

>3300006178|Ga0075367_10000108_6
[plants-endosphere-populus endosphere]
MAFGNKSKPTRKYNYGCRGFLSGPREINPDGTKALRQRFDGHDLAVTQMKLAHQFQNKLVEIERARREAIDPILVR
HFPALTTLHNAAQEQQERLQELRDELSQSNSQNRQLMSDPELVEQINAQKRVVSQAWEFYSDQRDAAFADPKVKAD
LKDNDKSFEQRKADARNAAVEGGLYWATSLQVVGRVKRTGPPPKFKSWRGEEVISVQFQRKPDKTSPKEPVLDSKG
NPKIHPRSKKPTFAHVGGSSLRTCDVFTPNTNCWIERTYQPPLTAPHPKYVVIHFRVSSDEKGKPVMASIPAVMSR
PLPEDGEVKWVHLSRRKIGTHYRWDVQFDIARDAWTYHPAGQDRAQEGTVAVALGWRLIDGEIRVTEWVGDDGVTG
TVRIPKELVEGWSYLDTLQSIRDTLFEAERAELVDWFVNYPNPLPEEWTERAQTLIQWRSADRFMWLIWWWKDHRI
PGDEEIFQRMWGRIQLNPTTGRNQYTGGRLQSKHLCDWRAHKRDKIKNWRKDFFRKVAIDLSYQYKDVVIAEIDWN
KLAENPEVENGNDIVNKRYRALSSCAQLRDEITRYMNEVTESARNIVTTCCQCGESCDHPKSGRWIRCESCGGEKR
DRAVNAATNLLNRALGASGAKVPARV (SEQ ID NO: 183)

>3300006178|Ga0075367_10000108_6
[plants-endosphere-populus endosphere]
MVAAKISHLLEFPSMAFGNKSKPTRKYNYGCRGFLSGPREINPDGTKALRQRFDGHDLAVTQMKLAHQFQNKLVEI
ERARREAIDPILVRHFPALTTLHNAAQEQQERLQELRDELSQSNSQNRQLMSDPELVEQINAQKRVVSQAWEFYSD
QRDAAFADPKVKADLKDNDKSFEQRKADARNAAVEGGLYWATSLQVVGRVKRTGPPPKFKSWRGEEVISVQFQRKP
DKTSPKEPVLDSKGNPKIHPRSKKPTFAHVGGSSLRTCDVFTPNTNCWIERTYQPPLTAPHPKYVVIHFRVSSDEK
GKPVMASIPAVMSRPLPEDGEVKWVHLSRRKIGTHYRWDVQFDIARDAWTYHPAGQDRAQEGTVAVALGWRLIDGE
IRVTEWVGDDGVTGTVRIPKELVEGWSYLDTLQSIRDTLFEAERAELVDWFVNYPNPLPEEWTERAQTLIQWRSAD
RFMWLIWWWKDHRIPGDEEIFQRMWGRIQLNPTTGRNQYTGGRLQSKHLCDWRAHKRDKIKNWRKDFFRKVAIDLS
YQYKDVVIAEIDWNKLAENPEVENGNDIVNKRYRALSSCAQLRDEITRYMNEVTESARNIVTTCCQCGESCDHPKS
GRWIRCESCGGEKRDRAVNAATNLLNRALGASGAKVPARV (SEQ ID NO: 184)

>3300006195|Ga0075366_10000160_13
[plants-endosphere-populus endosphere]
MAFGNKSKPTRKYNYGCRGFLSGPREINPDGTKALRQRFDGHDLAVTQMKLAHQFQNKLVEIERARREAIDPILVR
HFPALTTLHNAAQEQQERLQELRDELSQSNSQNRQLMSDPELVEQINAQKRVVSQAWEFYSDQRDAAFADPKVKAD
LKDNDKSFEQRKADARNAAVEGGLYWATSLQVVGRVKRTGPPPKFKSWRGEEVISVQFQRKPDKTSPKEPVLDSKG
NPKIHPRSKKPTFAHVGGSSLRTCDVFTPNTNCWIERTYQPPLTAPHPKYVVIHFRVSSDEKGKPVMASIPAVMSR
PLPEDGEVKWVHLSRRKIGTHYRWDVQFDIARDAWTYHPAGQDRAQEGTVAVALGWRLIDGEIRVTEWVGDDGVTG
TVRIPKELVEGWSYLDTLQSIRDTLFEAERAELVDWFVNYPNPLPEEWTERAQTLIQWRSADRFMWLIWWWKDHRI
PGDEEIFQRMWGRIQLNPTTGRNQYTGGRLQSKHLCDWRAHKRDKIKNWRKDFFRKVAIDLSYQYKDVVIAEIDWN
KLAENPEVENGNDIVNKRYRALSSCAQLRDEITRYMNEVTESARNIVTTCCQCGESCDHPKSGRWIRCESCGGEKR
DRAVNAATNLLNRALGASGAKVPARV (SEQ ID NO: 183)

>3300009500|Ga0116229_10010095_9
[plants-peat moss-host associated]
MTTLVYQFHLDPPVSGERAARQQMLAAHRYANDLIAIERGRRDALRAVHDTPAVREAEVLLKAATRSTRKAAVKAL
WAARREAERIASEVDETLPEVAAAKAALDALPKDAPARVRSVARQTLRAARAEAGDALARIQIFDEALRRGARALT
TAHWGTYLSIEASADQARKAPLYADDALTPASPRFRFGARRGYLDESDARSVWWCARSQVGMHVQGRVCRTSGVFA
GRDAWVRLEDAEPISHDHNTRRAILALRLDVDTWVRWPIRMHREIPDAARWSWVRVSCRPQQGARGKELWSVEITV
DDTAPRPRELAADTLRGAVAVELLWSPLDDGTMRVARWLDSEGKRGEIVLPRELVRGLGEIPSGIRSVRDQLLNDL
RPKLTRALRECTETMPTWLREAGATLHLWKSPSRFVDLARRWRASKCDAARAAYELLDAWELRDTHLDDYENGTRA
RSLRRRREVYRVLAARWAQSYATVLVPDRDLSREARWGEESERRFLASPQELRDCLRKAFGDGAVDVPWRGPHGVV
DDGDEDADVPEWLEKAIEQWRDEEKSGSARKGGKEKKNGEVAMSAWARRQAAARDRDLGKETARKAANNDAE
(SEQ ID NO: 186)

>3300009701|Ga0116228_10018148_5
[plants-peat moss-host associated]
MKIVYRYGLRAPIGHTPTNPTSKEVCKCPVCEQLFLAHSYANTLTEIERGRRAAVRALHAQVGDTGALELAVTEAN
QACEKAASNIKRLRAQAFSVLAQRGHTEGAAKRGTRVTPPEMARELADARKRKQEATTRLVEHRRKIREDPAMIVG
EHEITERAKELQRSARKYAGVYWGTYLLVERAHGASIASLPLYDGAGPNDPRFDRYRGEGSLAVQIQQQTGDPAFT
VEQLSGSDSRVQIQKEAGRLHTRLKRDEEGRVVREGPLVEMRRGNCIVARPQAVRETYSMVGDTMLRLRIGSENRA
PVWAEWPLKLSKPLPKGAIVSWVTVTKRMTGPREEWSVQFTLDTVDEVVQRDVDEEDARVVAVNFGWRLMGEELRV
AYWRSETGRNGDLRLPASMLAIRAEAEEVQSRRDKEFDETRARLCKWLASTEVPTWLRDATKALAQWRSQARLVHL TABLE 2-continued Amino Acid Sequences of Representative CLUST.018837 Effector Proteins*

AKGWRVQRFAGDQEAFETLEAWRYHEHHLWQWESSVRATAVRSRDDLYKRWAKILADNFDVLVIAGDFDVRKVAER
PEVDEEIQGPAAAATSRQFAAPGRLREILCHAFTKAGSKIAKERGADITRTCQVCGLVEEFDAARSVIRATPCSGC
NATWDQDDNACIELLARYDRTCEKSKNTSSDDGARAEPKNETKKAAGSHWDRARQKKVEKLKKVEAARQALENTG
(SEQ ID NO: 187)

>3300005577|Ga0068857_100000008_197
[plants-rhizoplane-corn rhizosphere]
MEPVKKSNARKTSTSETKVYSGAFLPKESEQIKLINDQLYFAHKYRNKLVEIERKRRNRFRNLRKLMSPELRQLE
NDLLLTEEKIIELRKSFGGRAENSLDPKFPKKNRQLTPQAVEIKDLKLKKKDLSAKIKSIHTQLNLDYFKEADSKF
SLLKKERLEQKAKELNKDSLGPNDVNRHNVVNNLYKEMIDGGNRFWAIKAKISKSAEASNKRARSNCKCSSGTYVS
IEEAAKQSFSNSKFEPKFKSFDGSGKIGMQLTQNKGLSIKDALSGSSPVLKIDLHPEVYLRQNKKKNKVLATARIK
LFGTEKTGKFVDIPFIMHRQMPEDATIKWVFLVVSKIGYRSIYNIQFTIESNSFTQPSAIRPDDVAINLGWKVNDQ
TDDITVATSFDGKNYNELILPSKMRANIVYKETLISHADKHFDSVKKDVSKWLKNSNLDECITKYFTNLPQWRSHK
KLLFVSKELAKVFLPDNTWYDLWKKWKTHCKENKPWKNCSDKDDLFTTLDNTIQWCKDNSIDDPNVQMAFYLKTWA
EKEIHLINWARGIESKLRKHRKEIYRCFAKKLSSTYGKVIVENWDKSKTAETPDVENDNRTKQEENANAVRQFVGV
SVLTDALKQKFGKDFCEENAKNISKEHFKCGGELINQKELSDVHCKKCNKSVNVNYNAAAHLFDRHGERSGAVKLP
GTARKTRKSPELLA (SEQ ID NO: 188)

>3300005338|Ga0068868_100030384_5
[plants-rhizoplane-miscanthus rhizosphere]
MRTYAYGARPPVENAELVFEQLRLAHAYQCALVAIERRRVVVDRLYQSACPAEWNAYEAATARVQETIPRMRMTR
TRPGDMLPPDMEMQVEEREIVKQIKADLAAAREAEQVARQAWYAAKKMATPRLRARLRMCDRGAYARAKRAYNLAS
AVGLAWGTRLKIAESVERAGKAAAKHGTLPHFPREDGGGTIAVQIQGGLDAEAVEGGVDTRERLNVVDAATWNALQ
GKSATQSVKKSGRVVDLPQPIEGSRRSTLRRGPIARLRIGSEGRQPIWAAWPVTLRRGLPLKALIKWVQIHARKIG
SRTEWQLLVTVDDAKPAVHAEGPILAVNLGWRNLEDGGLRVGYAVGSDGREEEVRVPPRYTSGVAHVDSIRSIRDK
LFEAVKEFLSDWSDESPRPPDWLVDATRHIDQWRSPARLVTLLREWERKREVGDRKTWERLSAWKTKNAHLRFWEC
DERRKLLRMRLDFYRCLAARWASQYARVVVTDMDLRDFAKLPEPEEAADTEGQTQRRSRVLAAPSELRGAIKNACS
TRGTGYEEKKAAWKTQTCNACGVVFAFAAKQDLLHICECGARWDQDANHCRNLLASGPVLHGAMGSLAPTGKQMES
TDRPAVDGRWKKRRSRTTVEALKKTAKSA (SEQ ID NO: 189)

>3300005841|Ga0068863_100041042_2
[plants-rhizoplane-switchgrass rhizosphere]
MPRARKEKSPTKTYTYGLLPPEHGGEDLMRMLRAGHNYRNALLEVERDRLAETEDFWAKRGRYTELVARVRELEAV
RFPRKDDPRRQAHYDLIDDLREKVREKREATIQGSLPAEEGRRRLRSRELKAEAKKRGETLTKEQMTRLLDREPGC
VSVRRKAQLDYEAQSRARGVEPSPKGMVAHLRALGLNTITQEIDDRATQKAKKAREHEKVYYGTYLLIEAQVERAL
EKTQFPRFKRWTGEGRVGAPVDTNEGLSVDSIHDCQFDSKHGWEENRGNTVLQIDPVGVSCAKGFHTRARVCVDSR
GRSGSKRLSVWVDFRINYHRELPRGAKICGAWINTYTLGTRVKYELQLQVQDSFQVQPRHGTGVAAINLGYRSSG
RVAYVLSEDGKGRELLVSPRIEASIGRADTSRSDRENSANRMCDMLLGWSSELGFPEAFLVGDGESKIDTWSGSVT
RRSRSLSTRISALKDAREESLSNKLRGILGTWAKLRQDKQTRPSDEATYAAFVEWFHQDKIYQNNEAFTRSGARNY
RDQVVRDWAHELCDRYEMLLVDGTDYAKLKMRPKDKSVMPIENQTETAHRRDNFAPGNLRSITEEVARARGVTVDR
HDPSGLTQRHHACGWDEPWDAMPRIEHKCAGCGETEDQDANFCVGLFERFRGILPPAPARSPRTSRKNRSSSGSER
AGGGQEAAE (SEQ ID NO: 190)

>3300013306|Ga0163162_10000022_153
[plants-rhizoplane-switchgrass rhizosphere]
MNRVYEYGLLDPVVNAQIVEDQLRAAHRYRNLLVEIERERRTRVREILSSHADAAPLAEDVARLTVELEQAQAKIK
QVRAVSRRRSETTDDRMAVRDVTTRLKAAREQLKIVKAAVAQDPSCQEALAQAEQRCHDRRIEERARCGVFWGTYL
LIEEDVDRARKGKMDPKEVRFTGEGRVSVQLQGGLEWGGIAEDTRIQIRDAPDPRQGRRAGTRKWLRLRVGSTGRD
PIWAEWPLILHRPLPEGAVIKRATVTRWRRDCRRWEWRLQLILDVSRCVGTKPRGTEGACALNLGWAKTERGLRVG
FVVGSDGERTEIVLPGSILDRLDKANAIRAQRDQNLDVMKPLLAAWIAAHPLPEVLHAKIEHLHAWRSADREFGLA
RLWRQHREDGDTEGYELLESWRYRDEHLQRYEAGMRRGALGHRREVYRLVGAALSRRYRMLIVDDTDLRTFQRSPA
PESDRVEFDAVKRSQHVAAPSDLRMQLANAFGEDGVAELSAVDVTRRCHACLTLNDWDRASSGREHACVGCQQVWD
QDVNACLNLLREWRTVAPGWEAARVAKASNRQASRAERLQQARRKKKPAEATAG (SEQ ID NO: 191)

>3300009148|Ga0105243_10000126_60
[plants-rhizosphere-miscanthus rhizosphere]
MPVIVYEYGLSPPKVNAALVEEQFRLAHKYRNMLTEIELERRTKIRAIMASHPDMVPFETELAEVQAEIEKLRGEI
NAIRMAARKRASTPEQSRRIKTLAARARELRTEIKERRKRVAAELAPDLKAIQDAAVQRRKDERAKSGVYWGTYLL
QEAAADQARDQPMPPKFTRWMGDGRVSVQIQQGLAKEGLWGESRQVQTATRIDSLVYDHEVTRRGDRRRLYRTTLR
MRVGSTDRQPVWAEWGIAMHRPIPDGAVIKVVTVSRRRCNSTQWWWRVQFTLDTTDCKPRQRPEYGVVACNLGESQ
TDSGAIRAGYLVGDDGFEQEILVAKSDLYRGRDLTPEQKQKAMTYVRCDLCLAESSEIRGARDKSLAEFKTRFLEWYQ
TAKATTFGEDAIPEWERDRMEHEHMWRSPARVREMMLHWASNRWAELDDPESRWPDSRGFEMMSTWVDEDTKAEVK
ESSLRNKALGDRREAYRIVAATLAKRYKTLLIDDTNLKHLQDGPEPEDAEGDIPAVKYQQRLAAGSELRQVLINAF
GGTNVVKMKPSNMTVTCSGCGARDVSWDRADGFRKHRCSACREIWDQDANFCRNLLKEYARGEAPEAKVAKPSRSQ
RFHESRKKKAAADQQEQG (SEQ ID NO: 192)

>3300006846|Ga0075430_100000057_67
[plants-rhizosphere-populus rhizosphere]
MATIVYRYGVRTRTETGRYDLPAEVWQQIHLSHRLRNALVEVEHRHDEAMRDLWSAHPQVAEVEQRLAAAEQMVAE
LIDQARLEHSQDRTTATRRGTATNLREARRAVRDARAARRAAIGEAYPVVKPGIEAVRAARKAAIKDLYREYCQDG
DLYWATYNAVVADHRIAVQAVERKRRQGQAAQLRYQRWDGTGTISVQLRQQAGQPARSPELLASGDGQWRNVLQVR
PWMPPEQFDGLTRGERKRHGRGEAVWSVGGGRTVTLPIQVHRMMPADADVCEAQLVVTRTGAHWSAALCVTVRLPD
PDPVEGRSPLALHCGWRHRPDGSVRVGTWASPEPLVPPANLADVLAAHDSGRWGEIVIPASWLELAGRPAALRSRR
DLALEPVQRKLAEWLDQNPQPDGDDGRPGLTGGDVRRWRSANRFAALAIRWRDTPPPGEGAAEMTAVLEAWRRQDK
HLWEWEAHSRARLRGRRDDAWRKVGAWLAEQAGVLVVDDVDLAALRQRGDVADDDPVLPGTAAGQARARAALAAPG
RLRQCATGAADRRGVAVRTVESGYLTRTCPHCGERGDAHPRYAQSAVVTCPSCGRSYDQDRSAATLMLDRERSGDG
PGKGERSQQ (SEQ ID NO: 193)

TABLE 2-continued

Amino Acid Sequences of Representative CLUST.018837 Effector Proteins*

\>3300006853|Ga0075420_100000070_3
[plants-rhizosphere-populus rhizosphere]
MATIVYRYGVRTRTETGRYDLPAEVWQQIHLSHRLRNALVEVEHRHDEAMRDLWSAHPQVAEVEQRLAAAEQMVAE
LIDQARLEHSQDRTTATRRGTATNLREARRAVRDARAARRAAIGEAYPVVKPGIEAVRAARKAAIKDLYREYCQDG
DLYWATYNAVVADHRIAVQAVERKRRQGQAAQLRYQRWDGTGTISVQLQRQAGQPARSPELLASGDGQWRNVLQVR
PWMPPEQEDGLTRGERKRHGRGEAVWSVGGGRTVTLPIQVHRMMPADADVCEAQLVVTRTGAHWSAALCVTVRLPD
PDPVEGRSPLALHCGWRHRPDGSVRVGTWASPEPLVPPANLADVLAAHDSGRWGEIVIPASWLELAGRPAALRSRR
DLALEPVQRKLAEWLDQNPQPDGDDGRPGLTGGDVRRWRSANRFAALAIRWRDTPPPGEGAAEMTAVLEAWRRQDK
HLWEWEAHSRARLRGRRDDAWRKVGAWLAEQAGVLVVDDVDLAALRQRGDVADDDPVLPGTAAGQARARAALAAPG
RLRQCATGAADRRGVAVRTVESGYLTRTCPHCGERGDAHPRYAQSAVVTCPSCGRSYDQDRSAATLMLDRERSGDG
PGKGERSQQ (SEQ ID NO: 193)

\>3300006854|Ga0075425_100000037_57
[plants-rhizosphere-populus rhizosphere]
MIVYKYGALKPKVIGGTFEDLLQYQRHSNAFYNALIEIERWRIAARDIVELAQSAPLSDEQKTEHRLAYNAACRAA
GAATPIGWGQKQAVTEMVAAAMKTRRSDEFKARQRASKKGYDFLKRVMTCARPRHRREDGEGILAATVQGATGLKA
SAVLTKPGPVQISGDGKHRTVTLRLREGLSLEVPIVYHRPLPERAEKEGVPYDVRVIFARLVIDRIGDRWTYSVHL
TIDAAPRVHVAQGGLGRCAVNEGWRRVPGGIRVAYAVDDDGNETSCVFPDALLGRQKHAESLRSLADEIAAAYLGD
AARRTKARCSALADPDAIHRELGREWFTMEQAAKRDGTDAEHWARRDRHLYQWERDEYASVLRARREIYRLWARKL
AASYDSVIIEAFDMRSVVKRTPSEDDIPAARHYRFLVGPHCLRLEIQSVFGARCEVLKPAKRTLTCHACGALCKWD
KARELRHDCESCGAAWDQDANNAKNQLLDAAE (SEQ ID NO: 185)

\>3300006903|Ga0075426_10000611_28
[plants-rhizosphere-populus rhizosphere]
MKRRTSPLPTRIWSYGCLRPTTNTDAFFDQLRKAHVYYNTLIEIERDRRAEYRKDRAKLCPDIEKFEAEFLELDKA
VDLFRATMKAEKKKKDDTGELKRLKDARKAIGEKLKALRLEMKNSPELKKLQEKEKEVVSGKVRAARKSSGVYWGT
YLLIEKAVETARRSKMDPRFAKWRGTGRIGIQLHHVKWSDIVDGKSQMFQVDPLPETQWDTRKGRRHAYTKARVRV
GTEKSATTGKQVPVFVEVPLYLHRRPPADAKLTWAWIFVTRKGPTLRYQLQLSVESNLFSAGLPEQPKKSVCAVDV
CWRKMDHGLRLGLAVDHHGNQFEMVLPKAVPELIEMGDNMKSAADRIENGTKDEVSKWIKENGLPGAIEPARVSQW
LSHRKLRGLTRQWLAETIGFERARELWRAWCFERVGSRKNPLTVPKKDLEAPAEEAFAWAEKHGLTKPFEQMAFYL
ELWSRKDRHLEQWAADQFYRATMIRRDAFRNWSRFLVNNYETILLEDMTHTTFAKDSVVEAEKSEDVLHRQRNEAA
PGLEMQTLRSAVGHVVPMDPADTTNDCAHCRHRNDWSQTERSKNVVLTCAGCGKMFDQDANAARTMLIRYFEGDT
GSGGSKDKPKPASPPPSKPPPRALTKRRKPGAEPRASV (SEQ ID NO: 194)

\>3300006914|Ga0075436_100000782_9
[plants-rhizosphere-populus rhizosphere]
MKRRTSPLPTRIWSYGCLRPTTNTDAFFDQLRKAHVYYNTLIEIERDRRAEYRKDRAKLCPDIEKFEAEFLELDKA
VDLFRATMKAEKKKKDDTGELKRLKDARKAIGEKLKALRLEMKNSPELKKLQEKEKEVVSGKVRAARKSSGVYWGT
YLLIEKAVETARRSKMDPRFAKWRGTGRIGIQLHHVKWSDIVDGKSQMFQVDPLPETQWDTRKGRRHAYTKARVRV
GTEKSATTGKQVPVFVEVPLYLHRRPPADAKLTWAWIFVTRKGPTLRYQLQLSVESNLFSAGLPEQPKKSVCAVDV
CWRKMDHGLRLGLAVDHHGNQFEMVLPKAVPELIEMGDNMKSAADRIENGTKDEVSKWIKENGLPGAIEPARVSQW
LSHRKLRGLTRQWLAETIGFERARELWRAWCFERVGSRKNPLTVPKKDLEAPAEEAFAWAEKHGLTKPFEQMAFYL
ELWSRKDRHLEQWAADQFYRATMIRRDAFRNWSRFLVNNYETILLEDMTHTTFAKDSVVEAEKSEDVLHRQRNEAA
PGLEMQTLRSAVGHVVPMDPADTTNDCAHCRHRNDWSQTERSKNVVLTCAGCGKMFDQDANAARTMLIRYFEGDT
GSGGSKDKPKPASPPPSKPPPRALTKRRKPGAEPRASV (SEQ ID NO: 194)

\>3300007076|Ga0075435_100000061_47
[plants-rhizosphere-populus rhizosphere]
MKRRTSPLPTRIWSYGCLRPTTNTDAFFDQLRKAHVYYNTLIEIERDRRAEYRKDRAKLCPDIEKFEAEFLELDKA
VDLFRATMKAEKKKKDDTGELKRLKDARKAIGEKLKALRLEMKNSPELKKLQEKEKEVVSGKVRAARKSSGVYWGT
YLLIEKAVETARRSKMDPRFAKWRGTGRIGIQLHHVKWSDIVDGKSQMFQVDPLPETQWDTRKGRRHAYTKARVRV
GTEKSATTGKQVPVFVEVPLYLHRRPPADAKLTWAWIFVTRKGPTLRYQLQLSVESNLFSAGLPEQPKKSVCAVDV
CWRKMDHGLRLGLAVDHHGNQFEMVLPKAVPELIEMGDNMKSAADRIENGTKDEVSKWIKENGLPGAIEPARVSQW
LSHRKLRGLTRQWLAETIGFERARELWRAWCFERVGSRKNPLTVPKKDLEAPAEEAFAWAEKHGLTKPFEQMAFYL
ELWSRKDRHLEQWAADQFYRATMIRRDAFRNWSRFLVNNYETILLEDMTHTTFAKDSVVEAEKSEDVLHRQRNEAA
PGLEMQTLRSAVGHVVPMDPADTTNDCAHCRHRNDWSQTERSKNVVLTCAGCGKMFDQDANAARTMLIRYFEGDT
GSGGSKDKPKPASPPPSKPPPRALTKRRKPGAEPRASV (SEQ ID NO: 194)

\>3300007076|Ga0075435_100000750_29
[plants-rhizosphere-populus rhizosphere]
MIVYKYGALKPKVIGGTFEDLLQYQRHSNAFYNALIEIERWRIAARDIVELAQSAPLSDEQKTEHRLAYNAACRAA
GAATPIGWGQKQAVTEMVAAAMKTRRSDEFKARQRASKKGYDFLKRVMTCARPRHRREDGEGILAATVQGATGLKA
SAVLTKPGPVQISGDGKHRTVTLRLREGLSLEVPIVYHRPLPERAEKEGVPYDVRVIFARLVIDRIGDRWTYSVHL
TIDAAPRVHVAQGGLGRCAVNEGWRRVPGGIRVAYAVDDDGNETSCVFPDALLGRQKHAESLRSLADEIAAAYLGD
AARRTKARCSALADPDAIHRELGREWFTMEQAAKRDGTDAEHWARRDRHLYQWERDEYASVLRARREIYRLWARKL
AASYDSVIIEAFDMRSVVKRTPSEDDIPAARHYRFLVGPHCLRLEIQSVFGARCEVLKPAKRTLTCHACGALCKWD
KARELRHDCESCGAAWDQDANNAKNQLLDAAE (SEQ ID NO: 185)

\>3300009100|Ga0075418_10076301_2
[plants-rhizosphere-populus rhizosphere]
MTEKPPTKIYTYGLLQPTKNGHEFSKMCRAAHDYYNALLEIERTRQREEDDFWAKRGGYVDLLDEFRQLEAMRPRR
DDPKREEIFARRKELRKKLWELRDVTVDRSLPIEDANRRNHRELKKAAKAEGRNITDAEISASLDKDPSCVSPRR
RAQLEYTEEAKARGVNVSGRGLNQYLRDRGLLKVTQPIDDRAAEDQKRARDHFELYYGTYLLVEPAAEQAIERSEM
FPAFKPWRGEVGRVGAPVNTNTGISVEAIHNCFNEDPKTGERTFSDGGNTVLQIIPIRKEVRESRRVRVKGAPSAH
QQGMKFLNQTVMRICVRSEGRVGAQRIPVWVEFPMQYHRDLPPNAKVTAAWVIASQLGTRTVYKLQLQVQDEAFRN
PVKPCGRSTMAVNLGYRSTGRVAYALTQDGRYEVMDVKDRVGKCIDEADELRSLRDRDANRMRNDLFEWRDVEAYP
QSFLEGDGEKEVPHWSGDEKRRRSVKVRSMKTRIDGLVHARDDSLPTRLRAIYETWERMREQGLLRSVDDRIFKVF
REWYIEDKRSQDKEAHQRLNAHGTRELDIYAWAHRLCDEASLILVEDTNYATMKLKSNRRPKEELPVEISVSIARR TABLE 2-continued Amino Acid Sequences of Representative CLUST.018837 Effector Proteins*

RDMYAPGRMRKILEQVAVKRGVKIVRLSSVGLTQRHHKCGFDEPWDAMRSIQHKCEGCGVTEDQDRNECEGLFERY
RGTLPAAPARKAGKGKKSRDLPAEAE (SEQ ID NO: 195)

>3300009100|Ga0075418_10076301_2
[plants-rhizosphere-populus rhizosphere]
MRSMTEKPPTKIYTYGLLQPTKNGHEFSKMCRAAHDYYNALLEIERTRQREEDDFWAKRGGYVDLLDEFRQLEAMR
PRRDDPKREEIFARRKELRKKLWELRDVTVDRSLPIEDANRRNRHRELKKAAKAEGRNITDAEISASLDKDPSCVS
PRRRAQLEYTEEAKARGVNVSGRGLNQYLRDRGLLKVTQPIDDRAAEDQKRARDHFELYYGTYLLVEPAAEQAIER
SEMFPAPKPWRGEVGRVGAPVNTNTGISVEAIHNCFNEDPKTGERTFSDGGNTVLQIIPIRKEVRESRRVRVKGAP
SAHQQGMKFLNQTVMRICVRSEGRVGAQRIPVWVEFPMQYHRDLPPNAKVTAAWVIASQLGTRTVYKLQLQVQDEA
FRNPVKPCGRSTMAVNLGYRSTGRVAYALTQDGRYEVMDVKDRVGKCIDEADELRSLRDRDANRMRNDLFEWRDVE
AYPQSFLEGDGEKEVPHWSGDEKRRRSVKVRSMKTRIDGLVHARDDSLPTRLRAIYETWERMREQGLLRSVDDRIF
KVEREWYIEDKRSQDKEAHQRLNAHGTRELDIYAWAHRLCDEASLILVEDTNYATMKLKSNRRPKEELPVEISVSI
ARRRDMYAPGRMRKILEQVAVKRGVKIVRLSSVGLTQRHHKCGFDEPWDAMRSIQHKCEGCGVTEDQDRNECEGLF
ERYRGTLPAAPARKAGKGKKSRDLPAEAE (SEQ ID NO: 196)

>3300009156|Ga0111538_10081463_8
[plants-rhizosphere-populus rhizosphere]
MQRQKDDSITSRVYVYGCVPERVAPVHNEDRALEQMRLGQRLWNVLVAIDRARVARYRRIMADEAQERIDALRDQA
AALRDEIKTRRKQARKRSVDIGDLAERLAAVKSELSALIEEQKRTSTERHDARRAELTAMQERTNHRIKRARQAAA
SLGLFWGTYNDIVQRSDAGRKHGGELHERGERGEGTLTAQIMGGAIVTRCVEGAHTFFQVDPPQPGRKWRYARMRI
GSEERGGVKLAPVWLEIPIVYHRDLPPAGMIKSVSMTRRMLAGKPRWQLNVTLNLPAPKPTTRTAAVAIDIGWRLL
PEGVRVAYWMDDAGQHGQVLIPSRDISQFERVRSLRSNCDLSRDEILPGLAEWEGGLELPAEWAQRVAYLSQWRSS
DRLAGLYDWWRDHRLPGDAETFEAYTTWRKQYLHLAHWWRNLQDQMTLRVREQYRVFAAQLAGRYGVVYIEDFDLS
SVARKPKTEGDGEKSASSTYRQMVSPSMFRGALLNALQREGATVTELPAEYTTRICSTCGYGREWDQAESVMHRCG
GCGEMFDQDENAAKNLLRLVAQGVAG (SEQ ID NO: 197)

>3300005548|Ga0070665_100000073_173
[plants-rhizosphere-switchgrass rhizosphere]
MTTLAFKYGLGDPLDWDTDIADQLYLQNKLWNRLVEIERDARTRYRAVVGEDDAIAPLVRDIEAAKAQKEALLTER
KGLRAKARKRVPTPEIDARIAECATVVRELAQRIKTERVAAKERLAPHVRAIEEWRFGAVKEARNASGLWWGNYNA
VCASYDTARSRAMKDGAELQFHRFTGEGRLTCQIQGGTTPEQIVDGKCSLVRVDPLSAGAHSHPSRGERRRLQRTK
IAVTAYMKDGERRLLTLPMQMHRPLPDGAIVKQVVVTRRKIGTRYRWHAVETCSVPDAQPVQHASTSACGVNEGFR
QVLGGLRVATVSTSPSKTPDYLVLPEEWLRAMDRCEALQSARDEHLLPMHAAARELTRGEDAPESLRDKLDRIARA
PKIGSALLASLVLAWRDTHADWQSDKLVGFEAWRRNDKRAAEEQANLRDKLHASRTERYRLWARELVRDHALVGCG
KIELRKLAELEKQDGTENDLHARARSNRQRVSLYSLQLELARAAQLAGARVVMADGPLTSTCHACGATTLIKPDIM
QVCDHCSAVWDQDHNAALNALSYAQQSPPPRERSGDAQDTDQENQVFGEPAEEKKDSARNVRLAA (SEQ ID
NO: 198)

>OBLM01000011_1
[soil metagenome]
MHSRVYLYGLLPPTPACAPLVEQQMGRAHRYRNVLVEIERERRAKVREVMAAHPDMAPLEEQVNALVAERETALQA
LPRKAARNDPARANVRAMATRIRDLRGQIKAARKAVLADAEVARQLAEADEFSRERVRRARATCNVYWGTYLLQEA
DADRARMERMPPKEHRWTGEGRVSVQLQGGLEQDKMWGGDTRMQIDPVAPEAHDPLSPRGVRRRAHRTVLRLRVGS
DAQRGPIWAEWPMLMHRPLPKGAIIKVATVSRRYRNCTTWDQVLLTVSIPDESARPAPAAGVVALNLGFCERPDG
SLRAGYLVGDDGWTQEIVVPASTSELLGKCDSIRSERDKNLDAMRPLLSAWRQDQNLAFERVCRDVIAACETTPPE
LDGAFYRLAMYIVNGGHSLPSWLHERIQSVHAWRSHDRERKLALTWRDRRFPGDHAAYELLEVWRYRDQHLEHYES
GMRRRTLLRRREGYRIIAAAAAARYRTLLVDDTDLRHFQRKPDPEDGATVPEQIGLATMRVNQRLTACSGLREALA
SAFGSRVVKMSSQNVSRRCHACGDINLAMSSAREQTCTGCAATWDVDQNACLNLLGEHRRDDPDRETARVAKLANA
KPSRGKRLSAARASNGATVLAREASGN (SEQ ID NO: 199)

>OCTA010000646_37
[soil metagenome]
MKRRTSTAPVRIYAYGCRLPTQGGELVEQQLLFRHRYYNKLIEIELDCREKMRAARSASSEDVAHAESAFAIYETE
IVGVLDAIKAKKGAARAAKVDAAEERAVLAVLRDMKRKTIDDLHAAKLAARTPELLAEFTAIQEAANAEVRDARSK
CGVYWGTYLLVEQEVEQAVKAARKNHEDPGFRREMSVPNRQGQATIARGRVGVELIHGVPVATIMAGTDTRLQIHM
EKSDSKRGQTMARAKIRVGTAENGRSPIFAEFPFRMHRPLPADGVVKWAWISKSTKGRWVDWSLQIVVEAASLHRP
VRQPSDGGVVAFDIGWRVRLHEVVNELRVAYWHDDQGNHGELVLPSDDRVRVDSRGRKHRPEGVRGREDHVDSLRS
IEDKNFDAIRSELVAWKTGRDLPEWFVSALEWLHAWKSHRKLGAVEDQWRSNRFSGDDGMFAKVETWWKQHRHLYD
WESCERDRALNARKNTFRQWAPQFTRKYAVVVLEEKFLAEVAKLQAPDSTKANMPRPTRRNRTVAACGEFVLALKN
AAPGNGCTVDAEPCEDTTATCARCGYVERFDHRPLAHACARCGDVSGPVDQDRTAAENLLAAYAGKMSRSQSASEG
GNIVGDPDGSLVIPAQEGVS (SEQ ID NO: 200)

>ODAK010001378_33
[soil metagenome]
MIRVYRYGVASPHDGADLVYAQMRGAHAYRNTLIEIERGRRGALRDLESAEVRGLTAEVAAADEACQAIGSTIKVA
RAESRKRSERKVDLERLAEARSVKRAITGRLYEARRNHMLATRSAVDIVNELAKCLLKSAREHCGVYWGTYLLAEE
AMGASSSAPLEGKDGITQNDPKFIRWTGDGAVRVQIQKGASVAVRADAEHSQLQIREPTGAWSHPTRSERRRLAK
RGEVRIRVGSEPNGKPVWAAWRLDMHRPLPEEARIKEATIHVRQRGAHSEWSLLVTVDVPPAAVVPSESRGEAVGV
DVGWRLIDGCIRVAVCMGAGGAVTELRLDAPTIRLLRSSEALRSKRDERFNAAKARIRKAAAEPVAPEWLRESGKT
MHAWRSPQRLAQLHARWAEERFSGDDMVEGRLEAWWWTDRHLWSTEAQASLQGHRRRKDIYRVFAAKLAARYDVIV
LEKFDLRKVARTEETGEETPAGDNDTSRSNRQLASVSEFRACLLDAARSRGRSVVMVDASETTRTCHVCGLVEAFD
AAAHLRRTCACGSEWDQDENAAEVILARWRERPGDAKILVPARSTEIYCETMELLETRWQRVARLRKEKLARMDTA
RKSASNAAE (SEQ ID NO: 201)

TABLE 2-continued

Amino Acid Sequences of Representative CLUST.018837 Effector Proteins*

>ODAK010029943_5
[soil metagenome]
MMVEKYGTVPARIAPVIGAEQAAIQLRLANRLWNLLVAIERARVARYRKVMFDAAQGRIELLKAKLSALRGKIQVR
RQAGRRRVDVSDLTAESQEIRAAIKAEIKAHKATSAERHDARRAELDALSETSKSRIKRARQAAASMGLFWGTYND
IVQRADVGRRAGELHERRDTGDGTLTAQIMGGADPEECMTAHSFFQIASKCPLSGLVAGDVAETDAQPVKWQYARM
RIGSTGERQPIWLAIPIVLHRPLPDGARIKSVSMTKRKTTWSLNVTVAEPAPTPKLIGPRVAIDLGWRVVPSGVRV
AYWADTLGGEGQVVVSDEDIGQFGRVRSLRSRCDTMRDEYLPVLAAWTSGRELPAEWQAETIALVQWRSPDRLARL
IRWWARLPGDAEMFSRASAWRKQYLHLANWWRNLEDQMRGRLREQYRIFAAGVAKKYSTVYLEVFHLPDVIETPAA
ESEEVRTAESRYRQMVSLSVLRAAVRNACTREGCTVVDVAPEYTTLGCHLCGTITEWDTAASLMHQCKGCGAVWDQ
DQNAAINLLARGASGGAPPTANQPDRPRKWDRVRDRSRKSAQAAESAILAAAAVEMPAQRLSC (SEQ ID NO:
202)

>ODAK010029943_6
[soil metagenome]
MTKPLSGLVAETGLLFRAFRAARPSSKCLLSGLVVETECDNVVMMVFKYGTVPARIAPVIGAEQAAIQLRLANRLW
NLLVAIERARVARYRKVMFDAAQGRIELLKAKLSALRGKIQVRRQAGRRRVDVSDLTAESQEIRAAIKAEIKAHKA
TSAERHDARRAELDALSETSKSRIKRARQAAASMGLFWGTYNDIVQRADVGRRAGELHFRRDTGDGTLTAQIMGGA
DPEECMTAHSFFQIASKCPLSGLVAGDVAETDAQPVKWQYARMRIGSTGERQPIWLAIPIVLHRPLPDGARIKSVS
MTKRKTTWSLNVTVAEPAPTPKLIGPRVAIDLGWRVVPSGVRVAYWADTLGGEGQVVVSDEDIGQFGRVRSLRSRC
DTMRDEYLPVLAAWTSGRELPAEWQAETIALVQWRSPDRLARLIRWWARLPGDAEMFSRASAWRKQYLHLANWWRN
LEDQMRGRLREQYRIFAAGVAKKYSTVYLEVFHLPDVIETPAAESEEVRTAESRYRQMVSLSVLRAAVRNACTREG
CTVVDVAPEYTTLGCHLCGTITEWDTAASLMHQCKGCGAVWDQDQNAAINLLARGASGGAPPTANQPDRPRKWDRV
RDRSRKSAQAAESAILAAAAVEMPAQRLSC (SEQ ID NO: 203)

>3300005602|Ga0070762_10000001_34
[terrestrial-soil]
MKLVYKYALASPHENFDLIDLQMRAAHRYRNTLVEIERGRRAAVRLVEAEAGDMPAAQRALTMAIGARELADGAIK
RHRARSRKRDEPQEMRDTLRAARVAERDAAKAFRELRLKIKDSPAMIAARDAIGERAKELQRSARANCGVYWGSYL
LVEGAVSDSFSDTSLYNKDGHANDPAWARWTGEGSVGVQIQTATADKATKSLTVERAASGNDSRLRIVLPDERAWD
RSGRTHRECENMARQAQLSIRIGSNGRDPVWGSWRMDMHRPLPVGSTIQLATVHRKRVGPYDRWHVTFTLDVPAST
RASTAGTGTIAVDVGWRVMGDELRVAGWQDDTGDRGELRLSAKDLAVLRAPEAMRSARDLRFDAARLALSVWLRDH
REILPDWLRVISANVHAWKAEARMVALRNRWMDARFADDEAAYDALTNWAFRARHDWAVESCARGQALRRRREKYR
VWAAQLATKYDTIVIENFDKRRVAATSRDATTENETARANRVLASTSELVSCMETAARSRRAALFAVPCADTTRTC
PTCGLVESRDAAAAVRLECECGARWDQDVDGAPLVLLARWRERPGDAKIVVSAREQEKTNENGEKKEGRWAKVARL
RAEKVARMATAREADADGAE (SEQ ID NO: 204)

>3300005602|Ga0070762_10000001_32
[terrestrial-soil]
MWSIGASVATRCCRRRPSDRYGSDKRNKEIVTMKLVYKYALASPHENFDLIDLQMRAAHRYRNTLVEIERGRRAAV
RLVEAEAGDMPAAQRALTMAIGARELADGAIKRHRARSRKRDEPQEMRDTLRAARVAERDAAKAFRELRLKIKDSP
AMIAARDAIGERAKELQRSARANCGVYWGSYLLVEGAVSDSFSDTSLYNKDGHANDPAWARWTGEGSVGVQIQTAT
ADKATKSLTVERAASGNDSRLRIVLPDERAWDRSGRTHRECENMARQAQLSIRIGSNGRDPVWGSWRMDMHRPLPV
GSTIQLATVHRKRVGPYDRWHVTFTLDVPASTRASTAGTGTIAVDVGWRVMGDELRVAGWQDDTGDRGELRLSAKD
LAVLRAPEAMRSARDLRFDAARLALSVWLRDHREILPDWLRVISANVHAWKAEARMVALRNRWMDARFADDEAAYD
ALTNWAFRARHDWAVESCARGQALRRRREKYRVWAAQLATKYDTIVIENFDKRRVAATSRDATTENETARANRVLA
STSELVSCMETAARSRRAALFAVPCADTTRTCPTCGLVESRDAAAAVRLECECGARWDQDVDGAPLVLLARWRERP
GDAKIVVSAREQEKTNENGEKKEGRWAKVARLRAEKVARMATAREADADGAE (SEQ ID NO: 205)

>3300006796|Ga0066665_10000988_15
[terrestrial-soil]
MSEQLDDTPEQPNEVEETKKRKQRNKGKHPARIWSVFSRYLVSGREHFDKQVLLAHRFRNKLVELELQRRAAANVV
IAQASSELQPLIDALAAAEQVLEVSLQELKAVRAKHRRRAESAAQVDAVTNARTARNQASKALSKARKDAFASEAA
QVGLWLAEEHHFQAVLAARHAFINDGLYWPTATDVQDRARAMRKGAPPVERREGGAEQAGRIAVQIQQRTDKSQSE
GGITFEEAFSCSHGFFRLEKKPGRDPLPEIADQPDYKSKRQQLLTYARAWLRVGSEGKGARAKPCWVVADVLLTRQ
APKTARIVQVYLDHSVIGDRERWRLSLVLTNQEGWPKPNRASGCMVGIDLGWRLLDTGELRVAYACGADGQHHELR
LPASLVKVWRRPDRIQQERDNLENDVKARLLEWLKGREDLPDHWLHLWKSSTRLSRLVDHWAGRDINWSS
QRRIAGDEEILASLRGWVKRNLHLRDYQYHEREQLAAHRLDVYRKWADGLARLYQTAVLEDADWRDLARLPSPEDD
AVNETARYNQRMASPGLLASVITNMFAITSRVECANTTRECWRCGHTEAFDAEAQLIRVCPGCGDACDQDESAARV
LLARGQALNQSQVAEAAPSS (SEQ ID NO: 206)

>3300018429|Ga0190272_10000030_113
[terrestrial-soil]
MAVVVHVYGVPPVLHGERVRLPAEVDEQLSLAHCLREDLVTLEHQRQDAVTAVWSSYPQIAAIETQLTAAETELTD
RSAAAAAERSAARKKGPTESSEAVRQLKARIKDLRSQRRTAIADAHPTATPRLTAIADAHRAAIKALYADYSQGRG
LYWATYNDVVAHHQVATKRVAAERKAGRPANIRHHRYDGSGSITVQLQRQTGAPPRLPATIADEQNGPWRNVLYLT
PWVDPDTWATLARAEQRRRLGVVRLDLGNKRHLSIPVLVHRMLPADADITSARLVVRRVAGHRKIELHVTARIKD
PVTRSGGPAVALHLGWRREDGGAVRVATWRSTAPVHVPDDLNDLVHADTDHTGTISLPARWWHRVSTQPEMAARRA
TSLNDIRDQLVAALTDNPLTITADDEDAQPVPTAAAVATWRSPARFAHLARTWATDCPAGHQATAAALENWRRSDR
RLWEQQAHGTANTLAARADAYRRTMSWLLTGASRLVLDNTAIADLARRADPATEPTLPTAVTDRVAHQRIGASPGQ
LRS IATTTANSYGVAVAVMPHTGITRTHYRCGHLNPADDRYSAARIVTCDGCGQHYDQESSATLMLLAASGDVAAP
GSATARNPDTSAHA (SEQ ID NO: 207)

>3300018432|Ga0190275_10000082_154
[terrestrial-soil]
MTTLEARVAQYGCLAPIENADVVRQQMRLGARYYNELIALERCRRAVYRDLRRKYVDLESVEARVEELAAELMSLR
EAIKGVRKEARRRVDTADLDQRAKDVQSALRVARVALKDARQAARDNAELRAAVEQLDERAKIWSKALRAMRAPWW
GTYLLEEASAEQQARKATIDPSFRRARGRERISAAGEGSAEGRIGVQVQGGMTVAELYGCEDTRLRIEPVSPDAWHA
SSRGVRRRCSRTRLWMRVESAGRSPVWAVFPLILHRPIPDDARIKGAVVRLRVLGFREQWTVSVTYAREPAVMPER TABLE 2-continued Amino Acid Sequences of Representative CLUST.018837 Effector Proteins*

PGIVALDLGWRQRPDGSLRVAYCADDQGNHREVVMPESVRMRLRKARDLREIQDLHENRAVRWLARWLDAGKAPEW
LARERPHLGQWRSHGRLRRLVLDWRRTREVGDERIFAAMERWLHRSRHLYQWEVDAQRKALLARRELYRCTAAQIA
RAYGRVVIEQFDLATAKRLKAPEQGEDAPLAQRAQLHASAPGEFRQCLTQAVQREGGLVISVDASGTTSHCHACGG
VCSWEQGEELWHRCEYCGELWDQDHNAAINLLRRFTRDHSGDATNPAPARKPSKRAERFRKRHAQPAATDVAE
(SEQ ID NO: 208)

>3300018481|Ga0190271_10027355_3
[terrestrial-soil]
MELNAKPDDLELDDDIPAGEEEEKPDLDARVAQYGCLWPIQGEDLIRQQMRAGHQYMNNLIFIERCRRTCYRDLR
REHANITEIEDLCQTLAHELDELRDQIKGARKAARSRVETKELNAKAAEVLKRLQPARKELKAARTAAAQNEVLKA
AVKELDARVLLCQKFLRKQTDCFWGSYILVEASMKQVKKSKIDPYFRRWKGEGRIGVQIQHGMTVQRALDGVDRRL
RIMPAPTSFLGENKSASHARHKARHLLYIRVDSEGRYPVWAVFPMIMHRDMPPDALIKGVTVHCRKRGLRDKWSCD
ITFTKPAVKPAKKPGVVAIDLGWRKRPDASLRVAYWVGSDGQDGEIRMPERVSRRLRHSDGLREVQDLSENRMKSR
LKLWLNAVDARDETLDKPMVPDFLTAIQPHMDKLRSHERIRKLVKQWEHERFEGDEHIFWAVKQWERSSIHLYPWE
VSQRKSTLRYRREMYRLAALELSKRYGTLVLENFDLSKAKRKNAPEQGPDAPKAQRTQLHASAPGEFRQALVQVFL
REGGEVERVDAMGTTSSCHACGATCKWDQAEEISHRCEHCGTLWDQDYNAAKNLLLRYALPQAS (SEQ ID NO:
209)

>3300019874|Ga0193744_1000265_21
[terrestrial-soil]
MIVYKYGALKPKVIGGSFDDLLAYQRDSNVEYNALIEVERWRIAARDIVEMDQAGPLSDEQKTEQRLAYNAACRAA
GQASTIGWGQKQAVTEMVAAAMKTRRADEFKARQRATKKGYDEVKRVMTCARPRHRREDGEGLLAATVQGCSGLKS
SAVLSKSGPVQISGSGKHRTVTLRLREGLSLEIPIAYHRPLPERAEKEGVPYDVRVIFARLMIDRIGDRWIYSVHL
TIDAAPRAHAAQGGLGRCAVNEGWRRVEGGIRVAYAVDDEGNETSCVIPDSLIGRQKHAESLRSLADEIADAYLGA
AARRTKSRRQALASPDATHPGLGKIRFTLGQAANHAPEDAEHWARRDRHLYQWERDEYASVLRSRREIYRLWARKL
AASYDSVIIEAFDMRSVVTRAPNKDNIPAARHYRFLVGPHYLRAEVQSVEGKRCEISKPAKRTLTCHACGALCKWD
KARELRHDCESCGAAWDQDANNAKNQLLDAAE (SEQ ID NO: 210)

>3300020021|Ga0193726_1013919_1
[terrestrial-soil]
MIKNYEYGLLLDPTANAQLVDDQMRAAHRYYNQLVEIERERRAEIAAILVGHPDTEALAARVADLARQREEARLAIK
ATRQATRDRSETSQMRDRVKDLATELRAARATLKTARDVIKTDAVIVAAISACDDRATTRVKARRAACEAYWGSYK
LSEEAVDAAKKAKAPPHFKRWTGDGRVSVQLQGGISDGELFGTDTQVQVAPVSPDAHDLRKPRGVRRLASRTILRL
RVQSTEKGRPIWAEWPMILHRPIPEGARVKIATVSRRRDCRRWDWRVLLTLEIPDGASEHRRLIPASGAIALNLG
WCKRPEDAVRAGYVLSDDGVIDREVIVPPSTINRVEKSEAIRSQRDKDLDAMRVTLVAWLRAHEAGLPAWVVERTI
LSREPRAVPQVDTPRAEAVRDASQRTRAWHVAQWRSAARFRALAFAWRSQRFDGDGEGYQVLEDWRYRDEHLERYE
SGMRRGGLLDRRERYRMLAADLAARYRTLVVDDFDLRTFAEIPKPEDESANVKPHRKQQRYAAGSELRAALLNAFG
PTRVLRESSVDVTRACAAIVVDEATGAEHTCGQLDLWDHTVAREHTCSGCGATWDQDQNACKNLIGRWRERLGADG
SVETARVATPRKESRSERLRRTWKREPEAEAASTTEPHPSPSRVAPVAPATAAPTCQKSPIVTDGAATITATAPP
PSPLRAPSPVVPGQSAVRANRPIAAPG (SEQ ID NO: 211)

>3300020021|Ga0193726_1013919_1
[terrestrial-soil]
MEISRASGSHRVMPMCTQPVHACQCLQERATWDHVIKNYEYGLLLDPTANAQLVDDQMRAAHRYYNQLVEIERERRA
EIAAILVGHPDTEALAARVADLARQREEARLAIKATRQATRDRSETSQMRDRVKDLATELRAARATLKTARDVIKT
DAVIVAAISACDDRATTRVKARRAACEAYWGSYKLSEEAVDAAKKAKAPPHFKRWTGDGRVSVQLQGGISDGELFG
TDTQVQVAPVSPDAHDLRKPRGVRRLASRTILRLRVQSTEKGRPIWAEWPMILHRPIPEGARVKIATVSRRRDCR
RWDWRVLLTLEIPDGASEHRRLIPASGAIALNLGWCKRPEDAVRAGYVLSDDGVIDREVIVPPSTINRVEKSEAIR
SQRDKDLDAMRVTLVAWLRAHEAGLPAWVVERTILSREPRAVPQVDTPRAEAVRDASQRTRAWHVAQWRSAARFRA
LAFAWRSQRFDGDGEGYQVLEDWRYRDEHLERYESGMRRGGLLDRRERYRMLAADLAARYRTLVVDDFDLRTFAEI
PKPEDESANVKPHRKQQRYAAGSELRAALLNAFGPTRVLRESSVDVTRACAAIVVDEATGAEHTCGQLDLWDHTVA
REHTCSGCGATWDQDQNACKNLIGRWRERLGADGSVETARVATPRKESRSERLRRTWKREPEAEAASTTEPHPSP
SRVAPVAPATAAPTCQKSPIVTDGAATITATAPPPSPLRAPSPVVPGQSAVRANRPIAAPG (SEQ ID NO:
212)

>3300020034|Ga0193753_10002988_10
[terrestrial-soil]
MKEIRVYKHWAEPASAVDHHRLQSQLKLAYQYRRMLAMIENAARVAQRALVQADPAIAMLINQLAVLHEADPPATI
VITAAQEALRLARRDLHKTDAYKLEARAIGDRRQVLVRGARGLFSAQGLAWGTYQHVEEAHDQSCSENPYWEDVKV
RLTPGFGAIAVHIQNRVLPSGTLVGGRDTFVQIDAERYGLSTFRNGWRAIDPDGPSGRVQIPAGERRPCGGGAPRL
QRIRIRTGSDGRAPIWTEFHMLLHRPLPPGKILWVRAHQTRVGIRTMYNIQFVVDIDTAGRAPRARPAGGAVMDDR
APQARSHHVGDATDDRAPQARSMMSHAIVGVDIGWRKLENGDWRVAMAVIPDGTTDELVVPHDVLRRADKSADLRS
IRDQSRDAMRTRLLAFRETVVASLEDATPAPSADWLEATRTMHAWLKFGRFVRLRHWWAQHRFAGDEEIYSALCAW
LDNDRHLIDWQEFNIRRMKRQIDGLYQAWAMRLARSFDVIAIEDMNLTDLKASSPGLVSDLAHERGMVVGLSHLIG
WLKRATAGYNTRLVEVDPAYTTRNCRKCGFCRPASAELVIKCEACGFAEDQDITAGHNITARAVATLEEPTPEATP
VKRRVRRTRRRPNEATTEPNNG (SEQ ID NO: 213)

>3300020034|Ga0193753_10002988_9
[terrestrial-soil]
MIDRSEIDPGNRDAQLYQRGTTQLIDRLEIDPGANQGAIMKEIRVYKHWAEPASAVDHHRLQSQLKLAYQYRRMLA
MIENAARVAQRALVQADPAIAMLINQLAVLHEADPPATIVITAAQEALRLARRDLHKTDAYKLEARAIGDRRQVLV
RGARGLFSAQGLAWGTYQHVEEAHDQSCSENPYWEDVKVRLTPGFGAIAVHIQNRVLPSGTLVGGRDTFVQIDAER
YGLSTFRNGWRAIDPDGPSGRVQIPAGERRPCGGGAPRLQRIRIRTGSDGRAPIWTEFHMLLHRPLPPGKILWVRA
HQTRVGIRTMYNIQFVVDIDTAGRAPRARPAGGAVMDDRAPQARSHHVGDATDDRAPQARSMMSHAIVGVDIGWRK
LENGDWRVAMAVIPDGTTDELVVPHDVLRRADKSADLRSIRDQSRDAMRTRLLAFRETVVASLEDATPAPSADWLE
ATRTMHAWLKFGRFVRLRHWWAQHRFAGDEEIYSALCAWLDNDRHLIDWQEFNIRRMKRQIDGLYQAWAMRLARSF TABLE 2-continued Amino Acid Sequences of Representative CLUST.018837 Effector Proteins*

DVIAIEDMNLTDLKASSPGLVSDLAHERGMVVGLSHLIGWLKRATAGYNTRLVEVDPAYTTRNCRKCGFCRPASAE
LVIKCEACGFAEDQDITAGHNITARAVATLEEPTPEATPVKRRVRRTRRRPNEATTEPNNG (SEQ ID NO:
214)

>3300020156|Ga0196970_1000866_40
[terrestrial-soil]
MAYGHTALPAINWVYGCKRPFEGEELIRSQLRQANRYRNVLVAIERRRRTNFEQLVLRLCPELQKLETQRNNLTQE
IIELRAAMKAENARQRKTVRNPESTRRIKELQAQRQLLRPRIKELRDATYTHPTVKVVDENAAAWVKRARAACGIY
WGTYLVREATVKQAIKDARPGLPEFKRFTGQGAVAFQSQQGTSTALLEAGGGNNLVQMHWNEPRNRRGRRRGELWF
RIGSDANRRPIWAKASISQHRPFPPDTVIKFGHLHLTKCGTRESWSVRFQLVRESGFVRTGLAAAGRVGVDIGWRR
VPGGLRVAYWVGDDGREGQELLPEDFLASKQYVEELRSRRSLEFDAVRQRLATWLQMTSNVPEWLLDRTHSLAQWK
SVDRLCWLVKAWAEQRFSVDESIFPVLWRWRGQSLRLKEEESHGQRKLVVRRRQLYREIALRLAQEYRTICVEDFN
LQKLLTKPQVEQDAVEAGVTYHSQLAAVGELRMFLAERAADVLRLPAQGTTQHCHMCGAKSNASDKSQLVHTCQSC
SAQYDQDRNAALWLLRGGVPEYAIDGA (SEQ ID NO: 215)

>3300020579|Ga0210407_10000200_14
[terrestrial-soil]
MTMIRVYKYGLLRPIQNEALVRAQLRAKHDYRNTLIEIERGRRTAMRNVEEQHSELATAMAASRAALVELEESRQA
IRLARSKSRSRSETNVMKERVKQARIVRRTTSQALYDCRARVRPEMISARDVINERAAELVRGARALTTSYWGSYL
LAEDEVKAAAKQPLYDDSTPNDPRFERWTGEGQIGMQIQNGMTPGEVLSSEDTRLRISEPNWNDGKHVRTLRTLSL
RVGSEGRKPVWASWPLIMHRPLPPAARIKRCNVSLRRHSSREIWSAELTIECPNVTSAIREEHGWGRGGGVEGAVG
VDIGWRVVTDDDAGLRVCAYASEDGQDIGELRLSPHEITRLRKADEIRSIRDKRFDAIRLIVRDKLATLEVPAWLS
MSTLHMHVWRSPARLVSLSKRWSKERFANDEEVFDLLESWRYWDSQHYQWECDQRTKALRRRREKYRVFGARLAEK
YEVLVLEDRAEDDRTKPMDLRKFARRAQTEMEPENETARSNRHLAATSELRQALEEAFISHGGRVELAPCEDTTRT
CTACGVVDRGLDAETEIDVTCSSCGAKQDQDVRASNNLCERWRKAQNAGGARNAKAAKSEGRWKKARRLRTEKQQR
MGTFRNASDNSAE (SEQ ID NO: 216)

>3300020580|Ga0210403_10000550_35
[terrestrial-soil]
MTMIRVYKYGLLRPIQNEALVRAQLRAKHDYRNTLIETERGRRTAMRNVEEQHSELATAMAASRAALVELEESRQA
IRLARSKSRSRSETNVMKERVKQARIVRRTTSQALYDCRARVRPEMISARDVINERAAELVRGARALTTSYWGSYL
LAEDEVKAAAKQPLYDDSTPNDPRFERWTGEGQIGMQIQNGMTPGEVLSSEDTRLRISEPNWNDGKHVRTLRTLSL
RVGSEGRKPVWASWPLIMHRPLPPAARIKRCNVSLRRHSSREIWSAELTIECPNVTSAIREEHGWGRGGGVEGAVG
VDIGWRVVTDDDAGLRVCAYASEDGQDIGELRLSPHEITRLRKADEIRSIRDKRFDAIRLIVRDKLATLEVPAWLS
MSTLHMHVWRSPARLVSLSKRWSKERFANDEEVFDLLESWRYWDSQHYQWECDQRTKALRRRREKYRVFGARLAEK
YEVLVLEDRAEDDRTKPMDLRKFARRAQTEMEPENETARSNRHLAATSELRQALEEAFISHGGRVELAPCEDTTRT
CTACGVVDRGLDAETEIDVTCSSCGAKQDQDVRASNNLCERWRKAQNAGGARNAKAAKSEGRWKKARRLRTEKQQR
MGTFRNASDNSAE (SEQ ID NO: 216)

>3300020580|Ga0210403_10001296_17
[terrestrial-soil]
MIRVYKYGLLPPTQNINLVRDQFRAAHEYRNLHVEIERGRRAAVRELFDTDEIRAASELLSRTNGAERLPTYKSLA
ALRSKRLKESSTRVDETEELAAGLRRGARALTRCYWGSYLTIEAASDQVRKMPLYGRDGITPNDPRFIYWSGESQI
GVQLQGGLTIPVLHEARDTRLRLERVSLEPARGRHPASRCRMLWIRIGSEGRAPIWATFPLRYHRELPSNATIKWA
RVSLRREGLREEWSCEITIDIPGAHPRTLDTSLTGAIAVSLEWTAAVNELLVARTLDCQTGEYDELRLPARMVTGL
RKPDGIRSVRDKNLNELRPRLIAAFREPMAPWLAAMVARIPHWRSPDPFHALAMRWRREKCDDAREAYDILQTWEL
RDAHLWDYEAGSRREALRERRELYRVWSAKLSRRYKTVVLSDADLSVEARTTKEVQTDRQTAAVYELRQSLRNAFA
GEEESMGPGSNVQELCDRWNGEQTTGNIRNGEKSNTFEEVKGGAWAKRKSKKSSAKSILDATR (SEQ ID NO:
217)

>3300020581|Ga0210399_10010852_9
[terrestrial-soil]
MSVLVYKYGLRPPIEQADRVMLEMRAAHRYRNTLVEIERGRRAAQRALLAEQPQLAPFELALTVAQAELTQAYLEI
RAARQTTRRRSETEPMRVRLRETRAAVRDARGSLYLARAWLRADPALATARDRIDGVAEGLRKNARAYRGCEWGTG
GLIEKADEQARQMPLYDGAEPNDPREQRWTGEGRISVQLQGGLELAGLEADTQLRIGDGVRLPGQTKPSKHAERYR
TLWMRVGSDERRKPIWAVFPLKLDRPLPTNAIVKLAVVSRRLDGPRVSWTVELTLDTTTCARRESCGHGIVGIDLG
WRVEGDEIRVCAWDGDDGETSELRLHGRLLSGLSRADDLRAVRDKNENAALAAYLAWTDRQGPLPAWMRPRGIHQW
RAPGRLAGLCLRWSRSRFAGDAVGFDALDVWRRRDLHLWWYESGQRRGSLAARKDLYRRFAAWLARRHDTLVLEDF
DLTRVSFKGQANAQANANRHRVATSELRLILIHAFKSRGGRVVMMNPYMSTHECPVCHAVTAFDAAAYVTYSCLGC
GASWDQDESAAKILRERGSDVGDPQSARSENGPDSGGLAESRWAKAKRMKREKEAARNETGKGA (SEQ ID NO:
218)

>3300020583|Ga0210401_10033176_5
[terrestrial-soil]
MIRVYKYGLLPPTQNINLVRDQFRAAHEYRNLHVEIERGRRAAVRELFDTDEIRAASELLSRTNGAERLPTYKSLA
ALRSKRLKESSTRVDETEELAAGLRRGARALTRCYWGSYLTIEAASDQVRKMPLYGRDGITPNDPRFIYWSGESQI
GVQLQGGLTIPVLHEARDTRLRLERVSLEPARGRHPASRCRMLWIRIGSEGRAPIWATFPLRYHRELPSNATIKWA
RVSLRREGLREEWSCEITIDIPGAHPRTLDTSLTGAIAVSLEWTAAVNELLVARTLDCQTGEYDELRLPARMVTGL
RKPDGIRSVRDKNLNELRPRLIAAFREPMAPWLAAMVARIPHWRSPDPFHALAMRWRREKCDDAREAYDILQTWEL
RDAHLWDYEAGSRREALRERRELYRVWSAKLSRRYKTVVLSDADLSVEARTTKEVQTDRQTAAVYELRQSLRNAFA
GEEESMGPGSNVQELCDRWNGEQTTGNIRNGEKSNTFEEVKGGAWAKRKSKKSSAKSILDATR (SEQ ID NO:
217)

>3300005435|Ga0070714_100002341_12
[terrestrial-soil-agricultural soil]
MSLKVYRFGARMPLDRDLVVAQLRAAHDYRNELIQYERGRREAMRALYDTPEIRDAEALLKQATKSDRKAAKRALY
TLRREVLEARRDEAQAINALHHELQLGARALTRCYWGSYLDVESAMQQARAAPLYDEDGLTPSNPRFLRWREPMQG
QIGMQLQASRPLTTADAMRGADTRVRVERRDGPYATLWIRVGSEGRAPVWARVPIKMHREIPNAATWKWVRVSCEP TABLE 2-continued Amino Acid Sequences of Representative CLUST.018837 Effector Proteins*

RSLRDNPEYRETWSVEITVDDPAPRARDLDTSRDGAIALSWSWDVLANESIRVASYVDTFGRRGDIVCPASIAKGI
RKPDGIRAVRDMVWNEEQKEIIHRIKRNANAPRWLVEAANTMHLWRSIARVHELARRCRIEGIAEGPAYEALHKFV
ERDLHLYDYEKNARDEALRERREWYRLHACWIARTYRHALVSDHDLSREARWGDESDVRFTAAPDQLRGAIKNALG
DDAIVAYWDHEPEWCERACAAYLVGGARGEMFAERKEKTSNAWAARKKKKTETMTARKEAANASE (SEQ ID
NO: 219)

>3300009095|Ga0079224_100000262_28
[terrestrial-soil-agricultural soil]
MKRKKSQDESINWKYGCKSPRGEGAEILRQQMREAHNYRNKLVELELLKRQEFYDLERELFPEYADLQEQEKQQAD
KVEDLRKQWKKANARARTRTEQHLLKAQIAEEKQTLKDLRARMKEMKEQVRNSEELKERSKQIKKRHYQRLKDLRA
ETPAFWGNVGFVDQAAQSMASGSPPKYYRWEGEGFIGVSFRTPITPEVLMSGRNTRAWLEPCKTANNKAGRVKKTT
LHIAVESENRKLKMASLPIYEHRDEPDGCEITSVRVECKKVGQREEWSAVFQLRSASFAKPDAAADGMAAIHFGWR
RVDDGLRVASVVDEDGTEEVLILPESIIDSYAYVKDIQAIRDYLWNETIAILSAFLKQHSDSLPEPVKEASQNMHL
WKGRGRLVHLINVWSDHRFPGDEEMFLKLTRKGTPANEYHDSGWLHRDKHLWDIEANVRDNAALRRKALYREFAAK
MRRKYRHLITAKLDLKKIVSVKNPEEEDDAAMKHHSRVAAIHSLQAALSDSMRDGWIVVPAAKQASTCHECGAKFQ
DDSGDAYISCENCGSTFDREFNACKNLLFGPKQVNAAPALV (SEQ ID NO: 220)

>3300009095|Ga0079224_100170797_3
[terrestrial-soil-agricultural soil]
MAKRQREGTEALVYAYGLLDDQPELYSDPNVAAEVQRQRDFWDLLVRLEQEHEERVYQYLDEHAPEYRAAFEALCE
KRRELDRLIERKRRERAEAKQKVEDPELDSAIKNATRDWKLAQKEMWAALKKARREHKEALAALRAEFYARIPKCK
DSPLFWANYNRVRQSFDATLKRVRKQGQTVRFSDPHRDDVCLTVQIQKVRGVVGCSFEDLLSGRVSQLKIAPIDEA
AWYTTRANRRRLCRTEVTMQVDRAGNTVRALVAVDRPVPPEARIKSAQLVWRRVGERYVGKLCLTISMPAVERTNG
STAACGIDVGWRRTDDGGLRVATIVDSSGNVDHLELPADWMSGMDQVKRLSQYLDDAALDIATLLLGRDDLHPAIA
AAI KRWRPGLGAGHVNVAALRDAVRELGFTGLPAELCCGVRSWRDRKERCCWYHRHIHLSTWRDNLRRKLLLRRRE
IYRLAALTLAERYAVIGIEKLDLAKMAMTKKREDGSDPTLHSAARAQRQRACLHEFRTELEHQARKRGARLELVDA
SKTTITCHECGAETQPTRRDRMMIHMACDSCGAVWDQDVNAARNILLAAIGASGDMTPPDDDGGSGAYKRHSEEIS
DRSQLGAPLL (SEQ ID NO: 221)

>3300010343|Ga0074044_10013672_1
[terrestrial-soil-bog forest soil]
MNILVYRYGLRAPHENRDLALSELRSSHEYRNKLIEIECARRKRVRAAEDALLGKPRLKLAEAQSALDAAIKAVSK
HRAETRKRTTPAEMLATLKAAREAQHAASKAFRSARQLVQPRCSDCRKKDLPTPCEHATPEGVGLLAELDAAQDEA
KESIKKFRNESGPFWGSYLLVDKAAGQSFSELALYDIDGKPNDPSFLRWTGEGTLGVQLQGGLSVEAALAGQDTQL
RISSPPVACWDPSTGSRKARSRQSRESEVWLRQGSVGRAPIWCKFGLHMQRPLPPGAQIMWAEAHCRRVGPHFDWY
LTLTLKVDDAVALKPRIIPTRDAVAIDVGWRVFGEGETHELRVAYWSDGSNDAPVVIREKDIRVPGFVIPPRGELR
LDTATLNQLTQPEGVRSERDVLEDGVRARLIEWLKTPHENEPEWVDSDGVVVTLREHCKALHAWRSQAKMAALTSR
WGEWLKEHPDGDKWAYDMLVAWRGQDRYLWAVESRWRDRARLRRRELYRLFGVALARTYGTVVLEEFDKREIAKRP
KTEDDGEAHPARSNRQLAAVSELCECVAEAGTSRGRNVVEVPCENSTRECPVCGCVDERNAARKVTISCACGHVWD
QDDGAADTLLGRWRKRPGDAKMAGAPRKPKILNGDGSVENRMQRAKRKGAEKALRKMELSKTTT (SEQ ID NO:
222)

>3300010343|Ga0074044_10041345_4
[terrestrial-soil-bog forest soil]
MTTRVYQFGLRPPIEGIDLVRAQLRAAHHYRNELIAIERGRRSALRQMDDTEEVRKAAGAIGGTAKADRRKAIANL
RDARRRARESKPEEFKRIAEREHEMLLSARANTSCFWGSYLDIESAHRQARSAPLYGDDALEPSDPRFIRWTGVEP
PSGTYPRLPQSGEGQIGMQIQKKGKSSENGKSSENGKPSEEKRRLVTSDVFACLDTRVRLKRGGAKDGDPRYGFLS
LRVGSEGRAPLWATWPIKISREIPDAAEWKWVRVSLRHEGRRERWSCEITVNDPAPAARSLDSRLRGVIAVEWEWS
KLEDDSIRVARWADSMGETGMVELPGSIAKGIRKPDGIRAVRDMISHELRPRLARLIREAKGPKPPWLVAAANTLH
LWKSPRRAYELAERWTDPTLLPTARVVLFEWRARDEHLWDYEAGARSEALRERREFYRLLAARWARRYQSIILSDQ
DLSREARWGEESDLRFTASCCELRGALRNAFGPDAFDGKYARSEQEDWQWCEQARDAWMAGGARKDAMCAKRKEQT
GNAWAKRKAAAAAKRAEKGSACEPPGKSV (SEQ ID NO: 223)

>3300005468|Ga0070707_100000083_12
[terrestrial-soil-corn, switchgrass and miscanthus rhizosphere]
MPVIVYEYGLSPPKVNAAIVEEQFRLAHKYRNMLTEIELERRTKIRAIMASHPDMVPFETELAEVQAEIEKLRGEI
NAIRMAARKRSSTPEQSKRIKTLAARARELRTEIKERRKRVATELAPDLKAIQDAAVQRRKDERAKSGVYWGTYLL
QEAAADQARDQPMPPKFTRWNGDGRVSVQIQQGLAKEGLWGESRQVQIATRIDSLVYDHEVTRRGDRRRLYRTTLR
MRVGSTDRQPVWAEWGISMHRPIPDGAVIKVVTVSRRRCNSTQWWWRVQFTLDTTDCKPRQRPEYGVVACNLGFSQ
TDSGAIRAGYLVGDDGFEQEILVAKSDLYRGRDLTPEQKQKAMTYVRDCLAESSEIRGARDKSLADFKTRFLEWYQ
IAKATTFGEDAVPEWFRDRMEHFHLWRSPARVREMMLHWASNRWAELDDPESRWPDSRGLEMMSTWVDEDTKAEVK
ESSLRNKALGDRREAYRIVAATLAKRYKTLLIDDTNLKHLQDGPEPEDAEGDIPAVKYQQRLAAGSELRQVLINAF
GGTNVVKMKPSNMTVTCSGCGARDVSWDRADGFRKHRCSACREIWDQDANFCRNLLKEYASGGEAPAAKIAKPSRS
QRFHESRKKKAAAADQQEQG (SEQ ID NO: 224)

>3300006163|Ga0070715_10000067_44
[terrestrial-soil-corn, switchgrass and miscanthus rhizosphere]
MPKKPNPNKRVSSDTRGARIWSYGVLFPREREVNDAIRSLLHQANRYQNCQVVIERVRRQRYRVIRSAASPELARL
EQEYKDLGLAIDAEVDTMRAQRASVRRRTTDPVIAAKIKALKAKRAAVNIELKIAREKANAILRPIQDAYNRHRKP
GGVKAAPRTAEKLNAAARQTTLEEDWPELAKQLLRLEDWATRRVKQAREASGLPPGTYLLVDQAIAATKKEPTDPR
PKREDGTRIGVQLFDFTPQTLFSRERKQLQIDPLPATQWDTRPGRRKARTELRIDEGGNAFEMKAAFKMILHRPL
PQDASIKWAWIHVTRIGSRLHYSLQLTMRSDTFQLKPGGQGVVAVNLGWRIKEDGAMRVAYVMDEFGTERELAMPP
ELRGGFVLAENLRSYSDQHFNVAKKAIGEFVKTDAAPAWLKEQCTSMHAWQRHGRLLRIARMLAIAEFPDTVLPSG
ERVRNGMLSELWKRWKEHRLAAVPKLDLFDTYQVITDWARARGATDLKAATLYLWVWKKKNDHLYNWECGLRAHKQ
KCRKQLYRAWATELATTYSTILVEKFDLRDTREKSAPEAEQEENPTSLIRSQNFAAPSELRDAIVAAAGTGRVKEQ
KSHNNTVTCHECGHTSDRDRRFEALIQVCESCGVVKDQDKNNCENQLSRYFSGESPGGGLDPESARNHENSSDLKT
DRDAAE (SEQ ID NO: 225)

TABLE 2-continued

Amino Acid Sequences of Representative CLUST.018837 Effector Proteins*

>3300014498|Ga0182019_10003703_1
[terrestrial-soil-fen]
MKRKTSPIPTKVYKYGLLAPVENVKLVDHAFYLGGKFYNKLIEIERTSRNEYRQERARRFPNHDKVEKLVATLSDQ
KKKLSEIIKASKIATKSRNVPPELATEYKTLAAAYKSAKLRQDAEREQCKKDRDFSAWTLTHNEKKNALVADARKN
SGLMWGTYNAIAASVQQAGASAILDPEFKSYRGEGRIVVQIQGGIYLAELGSDTQLQINLPNLNESLTRGEWRQSS
RTIVKMRIGSDKHKKPIWATFPAVEHRPLPSDARIMSATITRRRLGVLFQSSGRYEYHLCISCESTMEDNEAVRPRL
QDPTQQREVREHRGTSTINFGWRQFDQGKDKRLRIAMTNNEVTGLEPLWLPREIILGLQKCENLRSIIDMKFNEVR
ALLTTWLTPHKQDCPAWLAESLQFLHTWKQPDKLDRVVANWGSGMRFPADADIYPVLAEWRTKHRHLSEWMMRQRR
KSYNHRDDYYLKTAARLAQSSSRMVIENFTISKVAVKPGPEVEKTGGNEARHNRTLAAVSELRSALIHACSKHHCP
MDITPAVNNTRRCNVCGKLLDWDPAIKVDRQCPECSNWDQDVNATDNTNDKVASGDVVTMVVPAKTSENGEFEAGT
ISTFGSARKRLHNLEKTLTIQE (SEQ ID NO: 226)

>3300001131|JG11263|J13338_1000296_13
[terrestrial-soil-forest soil]
MPVTALPDGTISTARYAARGPVPAPVTEELRLGNWLDNLLTEYELDYEAAKAAAWEEDPHVALLLAAVTAAEQAWQ
AARDESAACKQKLGYAKRTGTPARIAAAKAAAAQAQQAYRAAVKARQEAAAALRDIKGLRWHVAKAAINAAAEERD
RKIAATYGPYRDRGGYWANWAEHAKHHKTAAKRVRDMRKQGQPAQLRYHRFDGTGTVVVQIQRELGVTPEIRAQVT
ALKAAGRTPGQIKAETGVRAMTAAKMKPEGAVKEGDPPCTAAALADETGKWRSSVRLTPELPAGFEELPRGERRRI
ASQGMFAIRTGSAANLAVSVVPVTVHRRMRGDGDVKYAKLTVTRNGPDKDMSVSLTQRVPAPQPRAGGRLVCVHAG
WRALPDGSLRVAVISGAGPLTPGLAAPGGRDARAGELTGVVRDLGDGCHEVVIPARWRDQDAATAKTRSVRDLARD
TAIAAAADWLAASPRYETTDGEPLPAAHEVRRWQSPGRLAVLGQRAARGDYGDDAAGLGELIAGWAVPDLEAWRRE
ARGRRHLTRRRDDAWANVAAWLCTGTREVRVDEWDIRAVTRRPGPGETDDPQAAAARANRTLAAPGALRQRLTITA
VLAGVTVTVLDPPDAGSVLQVHAGCGGVLDRDARRESIVVQCPGCGARVDQDVNMVRLMAARQPSA (SEQ ID
NO: 227)

>3300001593|JG112635J15846_10002852_1
[terrestrial-soil-forest soil]
MPVTALPDGTISTARYAARGPVPAPVTEELRLGNWLDNLLTEYELDYEAAKAAAWEEDPHVALLLAAVTAAEQAWQ
AARDESAACKQKLGYAKRTGTPARIAAAKAAAAQAQQAYRAAVKARQEAAAALRDIKGLRWHVAKAAINAAAEERD
RKIAATYGPYRDRGGYWANWAEHAKHHKTAAKRVRDMRKQGQPAQLRYHRFDGTGTVVVQIQRELGVTPEIRAQVT
ALKAAGRTPGQIKAETGVRAMTAAKMKPEGAVKEGDPPCTAAALADETGKWRSSVRLTPELPAGFEELPRGERRRI
ASQGMFAIRTGSAANLAVSVVPVTVHRRMRGDGDVKYAKLTVTRNGPDKDMSVSLTQRVPAPQPRAGGRLVCVHAG
WRALPDGSLRVAVISGAGPLTPGLAAPGGRDARAGELTGVVRDLGDGCHEVVIPARWRDQDAATAKTRSVRDLARD
TAIAAAADWLAASPRYETTDGEPLPAAHEVRRWQSPGRLAVLGQRAARGDYGDDAAGLGELIAGWAVPDLEAWRRE
ARGRRHLTRRRDDAWANVAAWLCTGTREVRVDEWDIRAVTRRPGPGETDDPQAAAARANRTLAAPGALRQRLTITA
VLAGVTVTVLDPPDAGSVLQVHAGCGGVLDRDARRESIVVQCPGCGARVDQDVNMVRLMAARQPSA (SEQ ID
NO: 227)

>3300009813|Ga0105057_1000075_5
[terrestrial-soil-groundwater sand]
MEDAMEADQTPATAEPAAGAVIVYRCGLRAPLDWGRDCDDQLYLMTRLWNTLVEIEHAHREAYFAATASDPVVAAI
EAEITGLERLLEQLYAQRAELRKAARKRVRTPELDERIAELKAKLKARRAEAKEARKAARETIKPQLETLEAERRE
AVKVARNASGLWWGNYNAVCADYDRARSAVIKRGGKLQFRRHDGSGRLVNQIQGGMSVADLLGRAHSQVQVTGGAW
AVNARGHLTATVYTRTAAAARAAGAGGTRRTVTWPLQLRRPRPGPYAQARIKEVVITRRRRGHKFDWHVSFLCQLP
ATEPALPAGRACGIDVGWRRLNDGVRVGTIVYSSGEREFVVLPERLVAAARRAQDIASRRDKIFNDLIVSWRAIDW
TNAPEELAATAVRLQKSKLSPPQLHGLVYAWRRHPFFAPDAFTVADRWLAEDKKLWETEASLARHVSNARRDLYRG
AAKRLVATCGLIGIEDIDLAALARRKTPAGGDNEIAQATAWWRRIAAPGELLAAISHAARRDGALIHKHSGKSTWI
CAQCGTESMPSDRSQLVHTCPHCSHTWDQDVNAARNLLAAALASAPVTLDGPAALAWEKPRDPNDLEE (SEQ ID
NO: 228)

>3300009813|Ga0105057_1000075_5
[terrestrial-soil-groundwater sand]
MEDRMEDAMEADQTPATAEPAAGAVIVYRCGLRAPLDWGRDCDDQLYLMTRLWNTLVEIEHAHREAYFAATASDPV
VAAIEAEITGLERLLEQLYAQRAELRKAARKRVRTPELDERIAELKAKLKARRAEAKEARKAARETIKPQLETLEA
ERREAVKVARNASGLWWGNYNAVCADYDRARSAVIKRGGKLQFRRHDGSGRLVNQIQGGMSVADLLGRAHSQVQVT
GGAWAVNARGHLTATVYTRTAAAARAAGAGGTRRTVTWPLQLRRPRPGPYAQARIKEVVITRRRRGHKFDWHVSFL
CQLPATEPALPAGRACGIDVGWRRLNDGVRVGTIVYSSGEREFVVLPERLVAAARRAQDIASRRDKIFNDLIVSWR
AIDWTNAPEELAATAVRLQKSKLSPPQLHGLVYAWRRHPFFAPDAFTVADRWLAEDKKLWETEASLARHVSNARRD
LYRGAAKRLVATCGLIGIEDIDLAALARRKTPAGGDNEIAQATAWWRRIAAPGELLAAISHAARRDGALIHKHSGK
STWICAQCGTESMPSDRSQLVHTCPHCSHTWDQDVNAARNLLAAALASAPVTLDGPAALAWEKPRDPNDLEE
(SEQ ID NO: 229)

>3300014489|Ga0182018_10031574_1
[terrestrial-soil-palsa]
MIRVYQFALRTPVDNEPLARAQLLAAHRYRNQHVAIERGRRWAVRLCEASEEVDEAVALVQSATKSTRKDALKDLR
AARKAARETHADELARIAELDAEIRRNARSHTSSYWGSYLTIEQSSDQVRRMPIYEPDGLTPSDPRFVRWTGAGQI
GVQLQGGALTPDVLAGRDTRIRLIDGVLWLRVGSEGRDPIWAKWPIVQHREIPSGADWKWARVSLRKEGPWERWSC
EITLEIPGEHPRNLDKDPQGAIAVEVTWDKPGDALVVARWRDDAGRTGTIELSEYDEQGIRKPDGIRSVRDQLLND
LKKRLPRAYAECRGDLGPPWLGEAIDGAQYWRSQSRAHTLLTRWRAEKCDAARAAYEILDAWWLRDMHLWEYEAGA
RGQALRRRREKYRVLAVTWSREYRHVILDDRVLSREARFGDASDLRFTAGPSELRQCLEHAFGGRNGGNVTTHPVR
DDAAKSETEERDWCERAIDAWIAGGARATKKVSESTGVKGGAWSLRKSKKSQKQAENGTAREPVAKGAV (SEQ
ID NO: 230)

>3300014501|Ga0182024_10047267_8
[terrestrial-soil-palsa]
MSKFRVYQYGLKAPTENAELVREQMFLAHRYHNTLIEIERGRRGAIRTLTRGHNATIRQLEADLLEADALVGKIVR
EIKTQHSETRSRLSTQTDKEELKVARQKKKEIKSQLIEARYLDKNNPSIINERTNINDLAKEAIKSARKHCGVYWG
TSQLIDDAVEASRKMPLYNGEKDNDPSFKPWKHQGSVGVQIQKRDDIQGMDVKNVFGADTCFRIDCVNEGAFYAEK TABLE 2-continued Amino Acid Sequences of Representative CLUST.018837 Effector Proteins*

```
RGDRRKQRKTTMRMRINSDDKGKPIWSYFPMTMHRPLPDGGIIKKAKVRLKKIGSREEWSLSITVDMSNVLMTTNN
NHEAVAIDIGWRDMKDDNGQTTGFRMCKSRGTDGKIEEIKLDPKIISAIKKANELRGLRDDNFNKERASFVAWAKV
NVLPDWLVKETKTIAQWRSISRLVKLFKQWKNNRFDGDEVIFGVSGKWNKGDKSVITGTGLAGWAYHDFHLWNWEA
NQRTKAIRRRKEFYRVEASKLAKQYQTLVLEDFDLSDVSQTAEPEAEDDNQRGRSNKTISSPSEFKLALINAFDAR
NGKIEKVNPKGTSYICHLCKSKEHLDSTFHIHTCSKCHQTWDREDNATANILTLWRERLSDEQNAVSARKDENGNE
NKGVEETRYQRRNRAKQEKKARLETARNAEANIAE (SEQ ID NO: 231)

>3300014501|Ga0182024_10150440_2
[terrestrial-soil-palsa]
MIKTEKYGLLSPTLNADLVLLEMRKAHDYQNNLIEIERWRRDEIRKIESIYGNIPQLTIDYDIASNDYETILKTKK
KNNSNARANVSTPELNQQLKDAKSKRKACENKLKQARLSSRKDDKIKKAKDNISILENKKQSLLRKSDAAPWYGTY
MLIDHAFGIPSAKGKTKGMPLYNGINPNNPIFRNYNGEGRIGIKQFQPYEPINKIININPTSKFLQIVPIPPPKLK
KDGSQRKIGNKNLKLLRIRIGTGEKNAPIWAEFPMVYHRPLPSNSVINMVQITKKIIASREKWAVSISYEDNIQFS
KNEIKKVVAFDLGWREFPDRIRIACWKDNDGKSGEISLPIGLGIKKDSNDKIIKNKDGNDKLFHSTINKLRKVKEL
KSGRDLDFDRVKQLFGYFVNSGIIFPQWFQDWLNTTNKNGKKINDITYISKWRSQTKLSKLILQWKNNRFTGDEDI
YMWLEYWRYHDFHLRDYEYNLRNKSIGAIESLYKNTAAHYANNYDAAIFEDINLSNIAKGKVGSTNRQLTAPSKFR
NACKNAFNMRGKCYEEIIARNTSRECAVCHVLNDIGGKLEYFCSGCNVELDRDENAAENILERGRKKLSDNNTYID
SHENCEHDSNAKNAVGARIDENCNENNNLQYA (SEQ ID NO: 232)

>3300001356|JG112269J14319_10001968_12
[terrestrial-soil-peatlands soil]
MTRRVYQFPLRAPIEGAALVRAQLRAAHEYRNDLVSIERGRRSALRAVDDVPAVREAIAVVLAATKSTRRSAIALL
RDARKEARAKAADELVRIGVLDAQARRDARAITPTWWGTYLDIEAAHNQARSAPLYEPDAVTPSDPAFARGPRLGR
EAFAPDDARAAWWLGDGQIGVQLQKGLPTPGALAGADTRVRLVLRPADHPRDRYGTLWLRVGSEGRDPVWAQWPIK
LHRAIPDSAIWKWVRVSVAREGTRERWSVEITVDDAAPRPRDLDRSLAGAIAVEWEWSLLDSGAIRVARWADTRGG
SGELLLPERIATGIRKPDGIRAVRDLELNALKDSLQQALREASDVATPRPPWLADAASTLHLWRSPDRFRGLLYRW
QRERYDGARSAYEMLEAACHRDDHLYDYEVGARRGALGARRDLYRCVAARWSQSYRTVLMSDQDLSREARWGPESE
VRFTAGCFELRSCLRNAFGDADAIDSRWRDAPGEQEDREWCERTRDAWSAGGARGDGRFAIRKEKTTNAWAARKAK
SKAKRGGDEASRDPDGKGAE (SEQ ID NO: 233)

>3300007533|Ga0102944_1012316_2
[terrestrial-soil-pond soil]
MAGRKKKDAPPSRVWIFGCGEPVDGAELVRDQLFETHRYRNDLARHVLNSRQVYREARSEICRVAALEQEHLEAKE
ALDVLRQEQKAWSAAARRRVQSPELQQAIKDAKQKKRDVLERLKQAREEVEQDPELQQARAEINKRAAAEKKRLYN
ESPAVWGSRLRVDESWLQMRWGRMDPKFRREDGSGRVVVQIQKGMSVAQAFECKDTRFQLARPTRDWDRRTGRRGG
TRTMFRIRVGSEGKRRTPVWATFPVTLHRELPEDAQIKWVEVRAVRQGPDLRFQLHLTLEWHGFDPRSRGAGAVSI
VCGWRAMHDGTVCVGRWIDDSGRSDVLVLPADVGEAEKHASSLRSISDLHFDAARRVFKSRRHLLPAWVTEESAYL
DKWRSHARLAKIVGRLTAEILGDEAAHVWRQWRRYRQREGLDLHAPYEELSTWLSEQGEVDPARQTAFYLEWWRRK
NRHLHRVECNVRTKALRRRKAIYRNWAASFARRYETVLVDDFDLRQFARNAAPEEDARQDYLHGVMRLAAPGELRL
APFLHSLGGARAVKVPATEGLRRCYLCGSPMRRPDRSGTVEHDCGVITPWQTIRGLDMLRGAGVDTVAAEQKLLEGH
EAMKKLFRELARKG (SEQ ID NO: 234)

>3300005903|Ga0075279_10000001_30
[terrestrial-soil-rice paddy soil]
MSETDTMAFKFRILRIVSDEARIKREIREAHQLYNDLVAIERKRRDDTRLFWADRGGYADKLAGLRAAAEDAEKAA
ALTAKGDAGKKERQEIWAPVDTLKREIWELQRKTEEELSDPAKVRRKQRARELQAEAKARAGKALKKEALAALLDA
EPDCMSPRDRRRLELVREYEARGVAVSGKAVAQRLRDEGLVGPTEQIEEAARKAGYEAYLKRGVSPGTRAIIADAF
ERSLEDLEPWATQRFSRWDGHGSFGVQVQGGSLTEEVYSGEHTQVRLRRLEDTGKHREGSRRSGRRHELRVRIGSD
GRAPVWAVFEAIVDRPLPPEASIKRVVVTCDRLGVLDIYHVVFTCSVPSSVYHKRSGEQRGTVAVDFGWRSLGGEE
MRVGYWVNDRGESGEIRLPGVGVARRGTTGKNSPYEPKIRGQVPIRQLDKHTRDLTEIMAREFAEYDGGKICGGAL
RDVASWLSANVSIVPEWLTERTTGIHVWRSQHRLYWLAQDWKAQRFDGDAEIFERLSAWASDWAHLAEWERRQHAA
ILAARNEHYRLVAVGLAKKYERIVINGADFAAAKRRKTKDETDRLVMIDDRSRSQAHLAAAGELREEIVRSAKKWQ
AIVMKAKPNKATCHACGSTCVYDAAKDLAHECEHCGVRWDQDENCCRNMLCEWSGDGQTAGGARVSPNAKKSGEVL
RSKKRDEDGGPIGEAAE (SEQ ID NO: 235)

>3300005524|Ga0070737_10002282_10
[terrestrial-soil-surface soil]
MSTGTVPPAAGNTPPTGEVTVARRYGAKPGPIPAAIREELDRAHWLVNRLVEIDRECDEQVTAVWEADPQVGPVLA
AVRDAEDARAAASEELRRAKVKLGAVKSGRSRTGLDVARARVDAAREAVRQASAALKQARDRAGAVKQERWPAAAP
VIRAAQEARDAAIRATYPEFVARGGYWATWNDITGAHKRRRDRVQQLRRQRRPAQMRYKRRDGTGTLTVQLQRQLG
VSAAERAHVTGLRDAGLAPSQIAALITAGVPAAEVTPARVARLRAAGLSAPEVTQALVAGADPAAAAAASRTPGKA
ARRAALGEVLAAAAAARPPRTPGRRWRPQSVARVRAGGKDTPGDPPFTPDVLAGPAGPAALQVRPVLPPGYPQLPR
RQQRALARQGEVVERTGSAANAAYTTIPVVLHRPLPAGGDVKMGRLTVTRCGPDLEQSVSITARVPAPPPAAGHTA
AVHIGWRALGDGAIRVAITGPRTPPPRQLAEAGVVRPVGGCWEVVVPPRWQVALTRVDGMRSARDREWQQVRDRV
AAAIPPGHDTLPPPAQVRAWRSPGRMVTLAAACEAGEHGGHGRAIADLVTPWARRDRAAWRNESRARRRILRRRDD
AWAVIAAWLTAGAGTVIVDDWELPPLGRRPGLTEEDDPQWRAARANRVLAAPGALRARVRVTAELAGVAVAEFPVP
RPGQAHAGCGHPLDPDARREDVLVPCLGCGVKVDQDINMLTLMLDGAREGAPQAG (SEQ ID NO: 236)

>3300005524|Ga0070737_10031205_1
[terrestrial-soil-surface soil]
MTAYSYGCPAWAVPLAPRETDPVTVIAALAGTAQALRQAQAALPGGGEREWKRWAQALQARDQAREAVWVTGEEAL
AGQLRLACRLWNRLVEVTRGHERARAAVWASDPAVAAAQETLDAARAAVAACHERIRVSRQADRTTVPRDADKQAL
DEARAAARAAREARDAAREAAFPRLRARFAAAAQARLAGVKAAAAEATEAGLGWAACNDITWRRFPAALQKVDRER
AAGRPAELRFRRWDGTGTVTVQVMGGAGIPPRTLPALNSGRHPRSAVMRLQPWRDPSAGRPKGADRHGTLTLTAGR
SRRHGPLRLQIPVVLDRYLPADADIAEVKVTRFREGTRHRLVSAACYVPAPPGPPPGGATVAVRLSWRAAGGGWV
TAAQVGSSSPLPPLPRSLEHAVRGTAGGPRLPLVRVAPGSLSAEVLYYAGWRRLLERGEAIQAVRGQNTDILREKV
```

TABLE 2-continued

Amino Acid Sequences of Representative CLUST.018837 Effector Proteins*

TAALRDDPALAAAVKVTAGEVARWRAPRRFAALARRWPAGHPLRPLLEEWRRRDRHLQDYQACETAQVLAARRDAW
RCTAAWLCAGASAVVIDGTRLDAEKQAPGDDEEDPEGARGARRLLHRSAPGELRAAVEAAAARRGIPVTILKAAVE
PAAGGGA (SEQ ID NO: 237)

>3300005524|Ga0070737_10031205_1
[terrestrial-soil-surface soil]
MTAPGGEGTPARVMTAYSYGCPAWAVPLAPRETDPVTVIAALAGTAQALRQAQAALPGGGEREWKRWAQALQARDQ
AREAVWVTGEEALAGQLRLACRLWNRLVEVTRGHERARAAVWASDPAVAAAQETLDAARAAVAACHERIRVSRQAD
RTTVPRDADKQALDEARAAARAAREARDAAREAAFPRLRARFAAAAQARLAGVKAAAAEATEAGLGWAACNDITWR
RFPAALQKVDRERAAGRPAELRFRRWDGTGTVTVQVMGGAGIPPRTLPALNSGRHPRSAVMRLQPWRDPSAGRPKG
ADRHGTLTLTAGRSRRHGPLRLQIPVVLDRYLPADADIAEVKVTRFREGTRHRLRVSAACYVPAPPGPPPGGATVA
VRLSWRAAGGGWVTAAQVGSSSPLPPLPRSLEHAVRGTAGGPRLPLVRVAPGSLSAEVLYYAGWRRLLERGEAIQA
VRGQNTDILREKVTAALRDDPALAAAVKVTAGEVARWRAPRRFAALARRWPAGHPLRPLLEEWRRRDRHLQDYQAC
ETAQVLAARRDAWRCTAAWLCAGASAVVIDGTRLDAEKQAPGDDEEDPEGARGARRLLHRSAPGELRAAVEAAAAR
RGIPVTILKAAVEPAAGGGA (SEQ ID NO: 238)

>3300005534|Ga0070735_10023967_5
[terrestrial-soil-surface soil]
MEKRESTVVTIAPVRMCGTTIRVYRYGLAPPLDWDDECDAEMARLDRFYNALVEIEEAAQAEYRRLSSSDETALLE
TRIAAAEEAKDWGAAKALRAALKEIRAALRKANAAAIDAAEEKRKADAKAARQNCGAYWSSYNAVIRSVELARQKA
IKEGAAFGKRTHEPGKGDWRMTVQIQGGASVADVLGGKNSQLRIAAPAHFGALRDRPAGMSRKACRHGRVTMVVHN
TGGLRRVTWPLMMHRPIPPEAIIVGAEIVKRRRLGSRWDDWHLCVTVREPAPAPHESPDCAGVNIGWRRLSVERGL
VIDGAGLRIATIWDGATLNHVILPEEIISAAWRCDELTSAIDKRVDAATARIFKDSPHDPVARQLGDTFVESGRLR
VRDLWTFANAMTPAPDWLLAMLRACSRDRRERAGLLRRMARRRRDIYRVAAKTIAENYGRIAICAVDWAKLARLRE
SGKDNPLPPPARGYRKIAAPGEFEAELRRAIKARGGTIMDIKDSVSFLCHACGKEHAPSERSAAHHTCPSCGATWD
QDRNAAMNLFAALDSSGPAAIKPADSLENGKGEMQSTAYVGRFQRRAKQAQEAKLANKEALENASELVDETIGCK
(SEQ ID NO: 239)

>3300005542|Ga0070732_10013271_3
[terrestrial-soil-surface soil]
MIRVYKYGLLPPTQNINLVRDQFRAAHEYRNLHVEIERGRRAAVRELFDTEEIRIASELLSRSSGTERLPIYKSLA
ALRSKRLKESSVRVDEIEELAAGLRRGARALTRCYWGSYLTIEEAASDQVRKMPLYGRDGITPNDPRFIYWSGESQI
GVQLQGGLTIPVLHGARDTRLRLERVSLEPARGRHPASRCRMLWIRIGSEGRSPIWATFPLRYHRELPTNATIKWA
RVSLRREGLREEWSCEITIDIPGAHPRTLDTSLTGAIAVSLEWTAAVNELLVARTLDCQTGEYDELRLPARMVTGL
RKPDGIRSVRDKNLNELRPRLIAAFKEPMAPWLAAMVARISHWRSPDPFHALAMRWRREKCDDAREAYDVLQTWEL
RDAHLWDYEAGSRREALRERRELYRVWSAKLSRRYKTVVLSDADLSVEARTTKEVQTDRQTAAVYELRQSLRNAFA
GEESMGPGSNVQELCDRWNGEQTAGNIRNGEKSNTFEEAKGGAWAKRKAKKSSAKSILDATRQG (SEQ ID NO:
240)

>3300010373|Ga0134128_10000310_109
[terrestrial-soil-terrestrial soil]
MAFGNVAKPSRIYTHKSRPPHEGAQLASDQLYRAHQYANALIETERQRWNATQDLMRSMFPRIAELEARIDAINAA
IEAKNAAVKHQNQAARSRTATAEDRAEVKQLQSERRDAAKELTAERHRQTGVPKPRKEAWERIHAVINATTRDEKE
RKALRKAAQAAIDAGESPAPLTAEEDREAFGDPEYRRRRAAIDETANADRRAKRAVCEVYWGTYLCVEGAVDKSVE
DCAKGQPVRNGKPPVPPGPPRFRRWSPEGKLGVQLQGGLSWLDALAGTDSRLRIELQPLAARPTVSKSGKPLPLAD
PNSRRSRENSQVVVWARIGTEEDGRSPIWMKTVAHLHRHPPADAVIKWVYLQRNLKGVQTWWEAQPFVFEREEGWAK
DRETLRGEAAIDLGWRKVADGLRVAVLIDDDGERMECVLPDSWLESWAKAQSIQGFRDTEFDAIRPALVHWLKARR
EAGTLPEWLGEATGSLHQWKSCERLGKVVWQWKDQRFDGDEAMFERLVEWRNRDRHLHNYARGMEETAVRRRDEHY
HRWAALVRRRYALVKVEDTNWREMQHRPEATDDGKNATIGAFRCAAVGRLLETIQEHVWNVVAVEPAWTTKTCHAC
GHVDDFDSAKELVHTCSACGEIWDQDDNAARGLLKGRVLKWLTREGRKLPKAERVRDVEAAV (SEQ ID NO:
241)

>3300010373|Ga0134128_10011458_1
[terrestrial-soil-terrestrial soil]
MFGHESKPSRIWSFKARPPHEGGGLVTEQLRLAHRYRNALVALARRKHEDTEAALLRYRPRLGTLFGLASSLSEAF
SAAEDSVKARSVAGRRRDVLRGDERKAHAELRRAKEGAWAAYRRERSAAFRVPAVRSELDAIDAAFYSGWRAARDY
AVNEWGLYWGTYLPAEAAFNQSLKPPGAGKDDASVSAKENIRKRWGPPEFRRRLRGEEFVGHEGAVTVQLQGGLDW
YAAKLGNDTKLRILPVPAGLTPTTVTRPAFTRAERDRIKRLRREASLVRKELGRLGTPADPGGGDIDGRRSKLVAW
GHSVRGEIARIRAGATLRTTPLPPPDPGSKRSRAGRRAEVWRVGSRGPAGREPAWARAVAYIDREPPPGTVIKWV
HLRRTLAGRSARWSVQFVLSRDSWDAETAAAGAAGVDVNWWMTPVGLRVATAAGSDGSVSHLFVPNDVVDAWRKHE
SLQSIRSVNADAARAHLLAFRSSGVRLPGWFREASAYAHAWKGGAKLAELVWAWKGRRFPGDAVVYARLEAWRKQD
RHLHDWHGAQHDKVRRIRNDLYRKWARGLARRFRLGALKDTNYAAVRRAAPAGEEDKGFTRLYSGIASPGLLSRYL
REAFAECAELPANNVTRECHGCGMVNAFDQARVRFHACQGCGASWDVDENAARNLLRRAAGARREAI (SEQ ID
NO: 242)

>3300010373|Ga0134128_10096594_3
[terrestrial-soil-terrestrial soil]
MPTKVYTYGAKLPIHGLELLDDSIIHGHRYYNALIALNRARAEKIDALRHQLIPGLDDAEAAVVAAESGLEDLRAA
VRQRNAERRTKTATPEDRQAIKAAVASLKEAKAIRKEIRSRCRDCVEYKESLDKVWNDFSEASKAAYNESPCWWGT
KLHISQSVERAVESSAKIGGVPRFRRWEQVRFDPAAGDDGAFVGAGDGVAAVQLQGGMTVEELLAGADWRLRMEFV
ADGKRTSLRAARKVIFSLRLGSDGREPRWVRIPAYYHRGGELPVDAKIMWAMIVRRALAPRRQRDGSWRPWYEYSV
QLTVRTGEARPTADGGICGVNLGWRTKPDGSLRVAVAVGGNQETHECVLPAHMLAGWKLGETLQGHRSVNFDRIRA
VLADWLRGSTEPPLGLEVSAVELDRLATLANVAEDADRFRRGARTLRAWAANWTRPADLPAWLTTESQYVGLWKSH
ARLAQLLDRWRSQRFNGDEAAFSALMVWREREAHLQQWETALRKRLDGQRKDIYRKFAARLARRYQVVATEDTDYR
ALKLRKPAEDNADDAAVKEHMRHGAPGLMRQYLRGRAAVELRIKSKDISRIHIDCGGINSEDRRPSILIVCPHCKV
EYDQDVNAARNVLARAEVVNETPGAAREAQPKETGDDTLNDGGKRGRWSKRKADRSRKQVESAAQQ (SEQ ID
NO: 243)

TABLE 2-continued

Amino Acid Sequences of Representative CLUST.018837 Effector Proteins*

>3300010400|Ga0134122_10000107_57
[terrestrial-soil-terrestrial soil]
MPIRVFEYGLKAPICNGPLVEQQMRSAHTYRNLLTQMERERRQEVRTIMAAHPDMAPLEARLAEIVTQRDEVRKAI
TTSRGITRSRSESPELRALARELGKQIREIRAEIKANRQAVAAAVKTDLDRIEIASVRRIKEARAACGVYWGTYLL
QEADADRARQEAFPPQFRPWRGEGRVSVQLQKGLSIEELHGDDTQLHIDPVPPAAHDIGTRRGDRRRARRTMLRMR
VQSDGRQPVWAVWPMRYHRPLPPGSVIKVATVSRRRHDCRSWDWMLHITVEIPDAAMKPSPASGVVALNLGFCLRP
GGTIRAGYIVGSDGVEQEILVPRSVIDAISKCDSIRSIRDKNMDAMKAQMGQWLATVRATHEKIVQEIAARPPPAD
VDSAWYRFCAYWSMNGPAWPAWFAEATATLHAWRSADRFRRLAFRWRDNRFVGDATGFRILEGYSDQRFHDERDAW
RYRDEHLERYESGMRRRALLRRRESYRIAAARLSATYRTLLIDDTDLRDFQRSPAPESESIEITRIKRNRGLAAGS
ELRLTMVNAFNGLSGRVVKISPATKPCHACGVVNTWDRTEDREHTCTACHQRWDQDANACRNMLLAHERDQATDAD
APSKKRLSRSERLRKNRDAPKAA (SEQ ID NO: 244)

>3300010401|Ga0134121_10002041_17
[terrestrial-soil-terrestrial soil]
MQRKTTTAPTRVYSYGCSFRGVTKNADLVEEQYRRAHAYQQKLVELELQRRAAVRAVLATDAGVVKLAEVVAQHEK
ALTDDLVAAAAIKQATRSKKLPPELRDRLAQTKQDLRAARDAWKAARRLFATDPNTKAALDKTNTDHVVAVKAARA
ASGLAWGTYLILERAADQQRNEKMDPKHRGYTGEGRLAVQFQGGTTVAGVEGGEDTRMRIEPKPGGSRKRHICKLR
IGSDGRAPIWAEIEVFIHRQLPADSRITWARLKRTRRGRDYLYDLQITLESQTFAGVLQDMAHRRVAVDLGWRVTD
KGAGGLRVAYWRDSDGRHEELRLPAKLLSSLDYPDQLLGIETNWFERAKAKLLAWRADVVLPEEHRSYTGTLAHWQ
SPLTLASYVWWWREHRFAGDELIFATMDEWRVRRFWHYRDWRMFQRDKALAARKDFYCVFASKLVVDCKELVLEDF
DLSAFATKDTGPSAFRYWRRTGAPSELRLCLIAAAKKVGAKITLVDPAMTTRRCQACGSEEPWDQKTETVHTCKTC
GTTWDQDDNATINMLASGSMVSGTSESLDPAE (SEQ ID NO: 245)

>3300004633|Ga0066395_10000027_32
[terrestrial-soil-tropical forest soil]
MPITRIYRYGLLEPFLGAELVAEQMSLAHRYQNSLIELERGRRERVRAIMLGAPSLEEAQAIVDRAVKDLLDARQK
IKDVRKAAQRRAETEADRASVSEIVVRLREARRVLKETRAAVRADSAIALSIAGVNDEIAEEQKRRRAACGVYWGS
YLLVEQAMDAARKAIVDPRFRRWDGSGRIAVQLQGGLSWADACAGDTRLRVDLAPRAVGKGKPRPTVSLRVGSNGR
DPVWASWPIILHRPVPEDATIMWAAVHRTILGGKARWHLLLTLRLPDDEVVEKGGKGTVAVDLGWRQRENGLRVGY
MRDDAGDAGEILLEPAIVDGFKKVDDLRSIRDKRIDVMRPRLAEWLRERELPDWLAAERATMHLWKSAARFSRLAE
IWRGKRWDGDVEGFDLLWAWRAKDRHLWLWEANLRDKVLARRLDRYRVLGAELARKYHTLVLEDFDLRNLQRHAKP
ESETVEIGPVRGRQRIAAPSLLRQKLVDAFVARGGRVVEVPSANTTRSCHACGLVEAWDPVTNLMHACTGCGALWD
QDDNACRNLLLRERLGADEASEAARPTETEPKTSKWGRLGRHKKRPLASGNANE (SEQ ID NO: 246)

>3300005332|Ga0066388_100004304_4
[terrestrial-soil-tropical forest soil]
MLVGWERYNEARPAGGDVATCNNATMKRSEENGRVLVYRFRCPVAASNIPEAAETQFRLAHELRNELVAVERAHAD
AVAAIWADHPDVAATLQAQAVAEAAVAELVERAGKERIADRAKEPRAQTRAEIKAARATLAAARQDTKAARSAAYP
LVRPAMADAQTRRRQAIGDAGRGAKTRGLEWHTHDAVLAGHDTAVKRVAALRAEGKPAELRSRRWDGEGRIRVTLM
RHEWSHGCGAQPCGQPSPECPRRQPGDPLRTPALLAGGQGPWRNVCRLPAHMDPAICAEHPPRRHGERETILLRVG
SEEREPIWWELPVFVHRPLPPGADVAFVEVRRERLAGQTRLSVCVTVRLPPVATLTEGAVAAIHPGWRSVTGGIRV
MVIAASRPLGPIPERFAPVVRPLTGNHVEIIAPEEWVRVLGHADSVRSIRDQALDVIRRKIVDALAEDVPGVEVSA
ADVARWRSPGRFAALVRQWPNDHPLADVLWAWRRQDRHLWKGEAHERDQIAARRTDTWRHVAVWLCDQVAVIGHAP
TPIAELSRVPVIEDGDDRQATLARAHRALAAPAELVSLIEIAAGQRGVRIVEIDGARLTATHHVCGEVTGDLARDS
VMLWCSRCGIAFDQDANAATASLARTIGDLSSAKVQ (SEQ ID NO: 247)

>3300005332|Ga0066388_100004304_2
[terrestrial-soil-tropical forest soil]
MKRSEENGRVLVYRFRCPVAASNIPEAAETQFRLAHELRNELVAVERAHADAVAAIWADHPDVAATLQAQAVAEAA
VAELVERAGKERIADRAKEPRAQTRAEIKAARATLAAARQDTKAARSAAYPLVRPAMADAQTRRRQAIGDAGRGAK
TRGLEWHTHDAVLAGHDTAVKRVAALRAEGKPAELRSRRWDGEGRIRVTLMRHEWSHGCGAQPCGQPSPECPRRQP
GDPLRTPALLAGGQGPWRNVCRLPAHMDPAICAEHPPRRHGERETILLRVGSEEREPIWWELPVFVHRPLPPGADV
AFVEVRRERLAGQTRLSVCVTVRLPPVATLTEGAVAAIHPGWRSVTGGIRVMVIAASRPLGPIPERFAPVVRPLTG
NHVEIIAPEEWVRVLGHADSVRSIRDQALDVIRRKIVDALAEDVPGVEVSAADVARWRSPGRFAALVRQWPNDHPL
ADVLWAWRRQDRHLWKGEAHERDQIAARRTDTWRHVAVWLCDQVAVIGHAPTPIAELSRVPVIEDGDDRQATLARA
HRALAAPAELVSLIEIAAGQRGVRIVEIDGARLTATHHVCGEVTGDLARDSVMLWCSRCGIAFDQDANAATASLAR
TIGDLSSAKVQ (SEQ ID NO: 248)

>3300005764|Ga0066903_100000051_27
[terrestrial-soil-tropical forest soil]
MPITRIYRYGLLEPFLGAELVAEQMSLAHRYQNSLIELERGRRERVRAIMLGAPSLEEAQAIVDRAVKDLLDARQK
IKDVRKAAQRRAETEADRASVSEIVVRLREARRVLKETRAAVRADSAIALSIAGVNDEIAEEQKRRRAACGVYWGS
YLLVEQAMDAARKAIVDPRFRRWDGSGRIAVQLQGGLSWADACAGDTRLRVDLAPRAVGKGKPRPTVSLRVGSNGR
DPVWASWPIILHRPVPEDATIMWAAVHRTILGGKARWHLLLTLRLPDDEVVEKGGKGTVAVDLGWRQRENGLRVGY
MRDDAGDAGEILLEPAIVDGFKKVDDLRSIRDKRIDVMRPRLAEWLRERELPDWLAAERATMHLWKSAARFSRLAE
IWRGKRWDGDVEGFDLLWAWRAKDRHLWLWEANLRDKVLARRLDRYRVLGAELARKYHTLVLEDFDLRNLQRHAKP
ESETVEIGPVRGRQRIAAPSLLRQKLVDAFVARGGRVVEVPSANTTRSCHACGLVEAWDPVTNLMHACTGCGALWD
QDDNACRNLLLRERLGADEASEAARPTETEPKTSKWGRLGRHKKRPLASGNANE (SEQ ID NO: 246)

>3300010047|Ga0126382_10001209_14
[terrestrial-soil-tropical forest soil]
MDNAAYRVLVGWERYNEARPAGGDVATCNNATMKRSEENGRVLVYRFRCPVAASNIPEAAETQFRLAHELRNELVA
VERAHADAVAAIWADHPDVAATLQAQAVAEAAVAELVERAGKERIADRAKEPRAQTRAEIKAARATLAAARQDTKA
ARSAAYPLVRPAMADAQTRRRQAIGDAGRGAKTRGLEWHTHDAVLAGHDTAVKRVAALRAEGKPAELRSRRWDGEG
RIRVTLMRHEWSHGCGAQPCGQPSPECPRRQPGDPLRTPALLAGGQGPWRNVCRLPAHMDPAICAEHPPRRHGERE
TILLRVGSEEREPIWWELPVFVHRPLPPGADVAFVEVRRERLAGQTRLSVCVTVRLPPVATLTEGAVAAIHPGWRS
VTGGIRVMVIAASRPLGPIPERFAPVVRPLTGNHVEIIAPEEWVRVLGHADSVRSIRDQALDVIRRKIVDALAEDV
PGVEVSAADVARWRSPGRFAALVRQWPNDHPLADVLWAWRRQDRHLWKGEAHERDQIAARRTDTWRHVAVWLCDQV TABLE 2-continued Amino Acid Sequences of Representative CLUST.018837 Effector Proteins*

AVIGHAPTPIAELSRVPVIEDGDDRQATLARAHRALAAPAELVSLIEIAAGQRGVRIVEIDGARLTATHHVCGEVT
GDLARDSVMLWCSRCGIAFDQDANAATASLARTIGDLSSAKVQ (SEQ ID NO: 249)

>3300010047|Ga0126382_10001209_12
[terrestrial-soil-tropical forest soil]
MKRSEFNGRVLVYRFRCPVAASNIPEAAETQFRLAHELRNELVAVERAHADAVAAIWADHPDVAATLQAQAVAEAA
VAELVERAGKERIADRAKEPRAQTRAEIKAARATLAAARQDTKAARSAAYPLVRPAMADAQTRRRQAIGDAGRGAK
TRGLFWHTHDAVLAGHDTAVKRVAALRAEGKPAELRSRRWDGEGRIRVTLMRHEWSHGCGAQPCGQPSPECPRRQP
GDPLRTPALLAGGQGPWRNVCRLPAHMDPAICAEHPPRRHGERETILLRVGSEEREPIWWELPVFVHRPLPPGADV
AFVEVRRERLAGQTRLSVCVTVRLPPVATLTEGAVAAIHPGWRSVTGGIRVMVIAASRPLGPIPERFAPVVRPLTG
NHVEIIAPEEWVRVLGHADSVRSIRDQALDVIRRKIVDALAEDVPGVEVSAADVARWRSPGRFAALVRQWPNDHPL
ADVLWAWRRQDRHLWKGEAHERDQIAARRTDTWRHVAVWLCDQVAVIGHAPTPIAELSRVPVIEDGDDRQATLARA
HRALAAPAELVSLIEIAAGQRGVRIVEIDGARLTATHHVCGEVTGDLARDSVMLWCSRCGIAFDQDANAATASLAR
TIGDLSSAKVQ (SEQ ID NO: 248)

>3300010048|Ga0126373_10000093_102
[terrestrial-soil-tropical forest soil]
MPIRVYQFGLLPPIDGEARVRVLMRQCHEYRNELVAIERGRRAALRALHDTQEVADAVALVKASKGKPLREAIGKL
YKARRAAEKAASHCPGVAEASVPEDASDAERSRLRRVNLEARAAAGDAVARITLLDESIRRDARALSPLSPGAWAN
YQTIEAAATQVRAMPLYERDAVTPSDPRFVKGPRAGQAFPVSNPKSCWWLGDQQVSMHIQGRTVTTADVLAGKDAW
VRLELEPARLHGGTNGGKQQYSQYGVLKLRVANDTRCAVWASWPIKLHRAIPNAAKWQWVRVSCRRLARREVWTVE
ITLNDPQKIQPRPDVSGAVAVELLWTPLDDGSMRVASWRDSFGATGELLMSSRMVGAIRKADGIRSVRDTLLNALR
PALAEKIQHSADKLPTWLREVGNVLHLWKSQDRFYELALRWRKDKVDAARDAYELLQEWELRDAHLLDYEAGSRRN
GIGWRNHYYSNWAAGLARRYKAVIVPDRDLSLEARFGDDSDRRTTVSPQKLRDMLLNAFGEDAVKAVWKGPHGVPE
DSDDTWLEVVSEQWRNEENTGGACAAEKDNAVADVGGSAWAKRKARARERAAGKDGARKDVGNTAE (SEQ ID
NO: 250)

>3300010366|Ga0126379_10001683_10
[terrestrial-soil-tropical forest soil]
MFGRKRDTAGATIRAYEFGTRPVGDMALASQQLYRRHQLWNQFVEIERDTRAKYRALVATESTQRVAALHEQLEEL
RQQIRLHKKSAAYEHVLHGKLRSLVEAMQSALADRSPETVAIVKPRLYFADIVSYDGLRERAKQLRQALGVMRAEA
KAESRAKAEQLKAEREQLERERTDRVKAAMAASNLYWCNSDDVRASYEVARKRAMREGTELHFHRFDGGGKLSVRY
QQGLPVAAAFGTDTRLQIDPIDFSIWESADRAVRRRCWTKARLRIGSNDQRQPVWLTLDCWLDGRPGRHLPMEGTI
RAAAVIRRRVGTGFTHRLVLTVEAPLERRDLAVERHGTVGLDVGWRLTADNGLRVAYWSDGTAQGALTLPANMVGL
FEKVHDLQSIRGQHFNAAVERLQGYLEEHPGAMWLQEQCRYIAQWRSPGRLIVLLRDWQSDGTDGELLEHLQAWRK
KEDHLYSWQANLLDQTAAHRRELYRIFAASLGRYARVAIEEFDLRKVLQKPRPEDGAETPDGHMRTIAAVSVLRSA
IENYCRREGVEFVVVPSSGTTRRCHVCQSEQQFDQRSDLVHRCTTCGETWDQDYNAAENIRQFADRPAGDTILPSA
KISPEAPEARV (SEQ ID NO: 251)

>3300010376|Ga0126381_100020658_4
[terrestrial-soil-tropical forest soil]
MIVHTLYIKTVDSETRKAVLAQMRAGHNYRNELVAIERGRRWALRQAHETPEVAEAIALLKAATRSNRFERLKALT
RARRQAEEAIEKPQVYLACEAARIALRDEAAGTPRKKAAQAVYDAAREALCQSDEFHYAVGERDNWIRKAAYNDAK
CNWGIRAVVNQAFEALRKTGLYERDGVTAWEPRFRRWAPNRPTGTIGVQLQGGLDVKDALSGDDTQVKLLLNPPIY
KGSRQQRVRQFGELWVRIGSDGRSPIWARFNVMAHRALPTDAKIKWVKVHLTRTGPFERWEAHLTLDASAPPRPIT
NDRAVAVELLWSPQDDGSITAAHWRDGDGAEGFFALPAIIPTSIRKPDGIQSVRELLLNKMRPDLVALIKHYGSDL
PVWLKEATNTLHLWESPLRFYDLAQCWRDSGFMGAKGAYDRLHEWELRDDHLWRYEACARKTAIRRRRDFYSCLAK
NLSAQYRYVILPDRDLSRERRFGEERDIQFTVAPQELRAALTRCFGDETIEAPWRGAHGVEEDEYGDIDWLLFALE
YGRDEKEARAAREAAKSSGDVKLTGGKWARIKAKRKEKDDAERGTRKESGKDAEGLGGER (SEQ ID NO:
252)

>3300010398|Ga0126383_10032213_5
[terrestrial-soil-tropical forest soil]
MKRQAENVRSMVYQYGTVPARVAPVEGEELALSQMRLAQRLWNVLVTIERARVAGYRSIMRDEVQEQIDALRERKD
ATWQEIKATRQKARAKVATPGLDAEMMRIKTALRLLVEHKQSTKQQRHDARREQLNALAERANQRIKRARQAAASM
GLFWGTYNAVIQSADAGRKHAGELRYQGFRGEGTVTAQVMGGATPEQCVAGGHPFFQVAPATPGQKWRYARVRIGS
TSERQPLWVAIPVVYHREIPAEARIKSVSATRRILAGKVRWSLNVTVTLPPAEPRPAGQMVAIDIGWRLLPDGVRV
AYWQDGTGNHSEVRIADSDIAQFRKISDLRSICDRAREEFLPSLVEWLKPYELDEEWTHRARALAQWRSNDRIAAL
IRWWADHRLSGDAEIYQTAVEWRRQYLHLANWWRNQQEQMTLRVREQYRRFAAGIASQFATVIVEDFDLRQVTETT
EKAVGTYRQMVSPSLFRAAVINACKREGVEIRIVSGAYSTGACHNCQHIEVWDQAASILHRCGACGALWDQDHNAA
INLLASGGVVLWRINLVAAIGPLSQDRSQTGGKEAVES (SEQ ID NO: 253)

>3300017961|Ga0187778_10004454_1
[terrestrial-soil-tropical peatland]
MTARVYEYGLLDPTYNAQLVDDQMRAGHRYRNVLVEIERDRRTEVRNLLARHPDVEPLEAELLAARNDLADRRGQI
RLQRKSTRTRSEGASMREAAHAAKLRVAEIRQRVNDAKAAIKEDAVVQAAIATADARAAERVRQARASCATYWGTY
ILHEADVARARASGGEVHFARWTGEGRVSAQIQGGIPSTDLAADTQVQIAPGQSIKDRRVPPNAKILRLRVQSDAK
GKAIWAEWPMILHRPLPEEGRIKVVTVHKRRRDCRRWQWTVTFTVELLDGWTRGKCGEGAIALNLGYCRSYDHLKG
AIRAGYLIDDRGQEREVIVPTSIIDRINKSEAIRSQRDKDVDTMRALLVAWLRDHEAILPGWIVDRTILAKAPKDA
NSPEAPRIWHITAWKSAARFRALAFAWRAARFQGDDVGYDLIERWRYRDEHLQRYEAGLLRGALLHRRDLYRQLAA
ELSAKYRTIVLHDTDLSDLQRSPHPEEDRREIGGAKYNQRIAAGSILRGALDNAFKRAGGEVVIVDDHRITKACWK
CSEAEDWNQLDREHICGACGTRWDQDANACHNMLARERAGAEGRRQAARAAKTADRKETRSERLRRGLATKRKTEA
ARAM (SEQ ID NO: 254)

TABLE 2-continued

Amino Acid Sequences of Representative CLUST.018837 Effector Proteins*

>3300017970|Ga0187783_10000008_23
[terrestrial-soil-tropical peatland]
MEGNKSLPSRIYSYGANPAIENQKLVEDQMFLAHRYRNAMVEAEIERRKKVDEKLLSLSPSLARIEEKLAAATEEL
EKLRESIKEDHKLYFTKTAKDPVKTKAIAAQKKLVKGLYTERKALRTKLFASSKWKKEQEATEAEALAAHKELREK
SDLYWGTYLLVEQSMQGSRSGAPPRFMRWDGDGHIALQIQNGMTVEEALSGADTRLAIIPGRVEVDGSRTKETGIK
RKLGTALCKFRIGTDEKTHSPIFASIPFHMHRPLPEDAQIKWVHFIRRRVSTHCEWRLQFVLSQRKWVKEDQAQEG
TVGIDLGWSLDQEGYLQVACFAGSDGESGRLFLPADWLGEMKRVEGIRSIRDQNENDAKALLQAFLRTSKEKSWLK
EEAKTLPQWRSPAKLAWVIQKWRKERIPGDQHIFQAMEAWRLRDKHLYEFEANLRDQLLRRRESIYRNFAADLRRS
YKTARILKLALKEVHELPQAEEAPENPQLREHSRDACLSELVRCLRESMARTVEIDPKNQARRHHGCGSLEDLGAN
EKLHTCSRCGEIYERHENTARNLLGMMPAGAGV (SEQ ID NO: 255)

>3300017972|Ga0187781_10019688_5
[terrestrial-soil-tropical peatland]
MERLPTETSPLDVVEMEREIDEARTATGWPTATVVHRYGIASPHEGADIVHEQIRLARAYRRELVTIERARRAAAR
QAMTELAPEVGFAEATVVGADAACQWLAAEIRAARAATRKRAESRGMRDRLTRARASLRTHRAELFALRSRYATQC
ADCRKAKSESVPCPHATAEARRLLERVDAVNDQAAAAQRRARGECGVYWGSYLLVERAMQASRAMPLYADDGVSPN
DPSVPHSLSDSLGCQIQSTRPLTVAGAAAGTDSRLRIQPPPWPEAWLHEARLDPSAQSHPSHRLPGQRPDGTPAPA
TRADGTPARWVRDRACRQGEVRMRVGANGEWAAWRLDEHRAMPPNAAVKWATVVRRQRGPHTEWSLCLTLEVPLPE
ALPQTGRTVAVDVGWRQIGDELRVAAWQDSDGQKGELRLTKADLHALNASAEVRSLRDGKMESIKQRLAQWSAVAS
PQDCPEWIREALRTVRLWRNPVRLVRLLRQWREAGEPTRVVPRVAFDHLVAWADDDRHRWAEQESRRVWGLRRRRE
RYRVFAAELAKRYDAVVLEQFDLRRVAARPQTGRELESENEVARSNRQRASVSELRDALRNACRSRGRVVVAVDAT
DSTRTCPSCGLVADRGQDERVVLRCECGHEWDQDRDGAALVLLRRYREHPGDAKTLVAARAGATLAEPPKKKNDRW
ARARRMSTQKKERAQGARDSG (SEQ ID NO: 256)

>3300018064|Ga0187773_10011230_2
[terrestrial-soil-tropical peatland]
MENQGEESAAAVPSEEEAPLDARVYQFGLLPPRVNRDLVEDQMYLGHRYRCQLVEFERDRRDAVREILSSQSGVEE
IEARIADLAARRDAARAEIASKRSRSRSRSDSAEERATVREIGRQLKALRAEAKEARSIVASDEHVGAWISAENDR
AAQRQKDARVACGVYWGTYLLHESDAQRARTGKSYPKFPRWNGDGRVAVQLQGGLSPQKLDHGQDTRLQVVSSSHR
TGRRLGRGSLLRMRVQSNGRDPVWAEWPMILHRPLPEGVRIKTATVSRRRRGSQVDWCATITVDEPPRPIRATATE
EAVAINLGYARRPNGGIRVGYWVGSDGAGGEILCQGSAAYRPRSSEEQIRAAVTHVEESLKKADSIRSERDRGMNE
MRARLIAWIDDEVGGDPPDGVPWWIADARRHLHLWRSPNRFASLLRRWERGWWPDLDGGYAILLAWSRRDLHLERY
ETGMRTTARRDRREGYRLLAARLAARYRTLVVDDADFRNFQRSPEPESDYVEVDAQKWQQRVASPSELRFAFLSAF
GVDRTAKEPCEDVTRRHAPCGHVVDVAGDSRELRCPHCSEVEKREVLFDQDANACDNLLRGWLRKAPEMRQARTKR
PPSIRRQRMIAGAKKKREAKAAEERRREARGG (SEQ ID NO: 257)

>3300012204|Ga0137374_10001132_4
[terrestrial-soil-vadose zone soil]
MATLVYRYGVRAHGSARQQDAVVSDPAMLEQLRLGHELRNALVGVQHRYEDGKRAVWSGFASVAAADHRVTTGETA
VAELEKQARAEHSADRTAATRQGTAESLKAARAAVKQARADRKAAMAAVAEQAKPKIQALGDDRDAEIKDLYRRFC
QDGVLLPRCGRCAGDLRSDGDCTDCGAAHEPRKLYWATYNAIREDHQTAVKLVEAKRKAGQPARLRFRRWTGDGTL
TVQLQRMHGPACRCVTCAEKLTRRARKTDPQAPAVAADPAYPPTDPPRDPALLASGQGKWRNVLQLGTWIPPGEWS
AMSRAERRRVGRSHIGWQLGGGRQLTLPVQLHRQMPADADVAMAQLTRVRVGGRHRMSVALTAKLPDPPQVQGLPP
VALHLGWRQRPDGSLRVATWACPQPLDLPPAVADVVVSHGGRWGEVIMPARWLADAEVPPRLLGRRDKAMEPVLEA
LADWLEAHTEACTARMTPALVRRWRSQGRLAGLTNRWRGQPPTGSAEILTYLEAWRIQDKLLWERESHLRRRLAAR
RDDAWRRVASWLARHAGVLVVDDADIAELRRRDDPADTDPTMPASAAQAARARAALAAPGRLRHLATITATRDGLG
VHTVASAGLTRLHRKCGHQAQPDPRYAASAVVTCPGCGNGYDQDYNAAMLMLDRQQQP (SEQ ID NO: 258)

>3300012210|Ga0137378_10000107_47
[terrestrial-soil-vadose zone soil]
MENNITVMRYGARVPITGLESVDRQLRLSKKYRNALCEIERRRRDGIARVQHGTRAGASPLDADELLAPLILKIDE
LEAS ISEMRKQTKLTHAGGGNPAARASLRDQIAAVKADLAVLRWLRGWRSKRLRLSDDERAAIAMCDGEKMSAWMI
HRVKPWWALGVAVHATMNGSAALRLRCEYMIIDETAKYERRQARAVAGLSPGTYLLIEAAADKWRQNPEQPRFMRY
DGTGRVGVQVQGGCTVAELEGGQDTRMRLLPATEIDPPVAPTSSRQIARAIAYGVVHFCRAGNMAPRDTYRILQLR
VETMGRAPVWASIPIVYHRPLPADGVIVAAWLQRKKIGVRSVYDAQLVVRAAMTPQSHRPTTGTIAVDIGSRDIPS
TGETRVAYSLDSSGAHAAMILPLERLSSATSRGTGRRRIVPDDEKKIDDIKSIRSRHLDEIRDQITAYKVSVGAAA
SSPHPVPAIEWLRAATDRITSWRSPARIVWLRRQWQHHTGDEKIFSSIEAYIRQDRHLLDWQSREMRRRLGRRREL
YRTAAMRLARTYDTIILAARDYRREEWVPEDAPSTRAHESRSIMRGAAPGEFREIIRRSAKKYGTTLIEMPLEGDT
AWALDYRVCQRMLASTEVVDVQAAPLASASRSNHYGTDESEHRRRLGTDERIDPLARIDVSG (SEQ ID NO: 259)

>3300012532|Ga0137373_10000316_4
[terrestrial-soil-vadose zone soil]
MATLVYRYGVRAHGSARQQDAVVSDPAMLEQLRLGHELRNALVGVQHRYEDGKRAVWSGFASVAAADHRVTTGETA
VAELEKQARAEHSADRTAATRQGTAESLKAARAAVKQARADRKAAMAAVAEQAKPKIQALGDDRDAEIKDLYRRFC
QDGVLLPRCGRCAGDLRSDGDCTDCGAAHEPRKLYWATYNAIREDHQTAVKLVEAKRKAGQPARLRFRRWTGDGTL
TVQLQRMHGPACRCVTCAEKLTRRARKTDPQAPAVAADPAYPPTDPPRDPALLASGQGKWRNVLQLGTWIPPGEWS
AMSRAERRRVGRSHIGWQLGGGRQLTLPVQLHRQMPADADVAMAQLTRVRVGGRHRMSVALTAKLPDPPQVQGLPP
VALHLGWRQRPDGSLRVATWACPQPLDLPPAVADVVVSHGGRWGEVIMPARWLADAEVPPRLLGRRDKAMEPVLEA
LADWLEAHTEACTARMTPALVRRWRSQGRLAGLTNRWRGQPPTGSAEILTYLEAWRIQDKLLWERESHLRRRLAAR
RDDAWRRVASWLARHAGVLVVDDADIAELRRRDDPADTDPTMPASAAQAARARAALAAPGRLRHLATITATRDGLG
VHTVASAGLTRLHRKCGHQAQPDPRYAASAVVTCPGCGNGYDQDYNAAMLMLDRQQQP (SEQ ID NO: 258)

>3300012532|Ga0137373_10000407_43
[terrestrial-soil-vadose zone soil]
MIVYRYGALKPTEGFDLLLTQLRLACRYRNALVELLNWRIIAEQSGVERSAAKLVHAEMSCWLRSRCGLGWGTYQA
IEADVRRAAKSPYRAPRKVSGRARWFAQVRQIKIQRPPDADGNQDAQVREIGLDPTKFRARFRREDGTGRLGANIQ
ACSGATTDDVLSGRGSLRLSAPEGRVTARLYLGLGIHVTLPVIAHRPLPPGVQVVRALICVERVGDRYVYSVHVTM

TABLE 2-continued

Amino Acid Sequences of Representative CLUST.018837 Effector Proteins*

RHERPERQYGSGRAAINFGWRSLGDRGVRIAYVATDEGSTDELILPRRLIDKLRHSESLRGLADDAAVAYLGDARG
RTRARREALRDPSATHRELGRVPIEGEPISAEHWARRDRHLYQWERDEYAKVLRQRREIYRLWVRSLAAKYGSVVM
EDYDLPTLISRDQPTEIPEARHVRELVAPGSLRAEVQSVFGERATLATIKRRTMVCSVCGCELTGDRVRDVVLYCE
QCDAQRDQDANNAANQLIDTAAE (SEQ ID NO: 260)

>3300012930|Ga0137407_10020190_4
[terrestrial-soil-vadose zone soil]
MSTIVYREGVHGAPLDNLELVKQQMRAAHNYANDLVAIERGRRTALHAIDDVPDVRNTIETVRQSTKSTRKAAITA
LRLARKAARAAAEEELARVQALDESIRRDARAITVCYWGSYLTIEMSAQQQRSQPLYEDDAITPNLPRERGWREEG
QIGIQIQKGLPTSAVRACTDTRARLDRSDRKKQGSKGRSVEYADLWIRIGSDGRAPIWTRVRVIMHRQIPDAAQWK
WVRLSYRREGRTFAWSVEISVDVDRPKRTLDTTLRGAIAIEPQWSENADGSIVCATYRTEDGSSGEIELSPRIVGA
LRKADSIRAVRDMILNEARKDIHRALVEAGPALPVWLKDARNTMHLWKSQERFYRLANHWRRERCDAAREAYDRLQ
EWELRDDHLWRYEAGSRGQAIRSRNDFYHVIASQFARKHREVIVPKRDYSREARFGAESDLRFIVSPSSLVSALDC
SEDHGESAYVCPWVRPDGDGDSAEWPAIAIERFCAGDSAMIARKIRKENDSEEKQESAWARRKRLKREKEMRLATA
RITDGNGTKSLGQ (SEQ ID NO: 261)

>3300005987|1071089|scaffold14955_2
[wastewater-nutrient removal-wastewater effluent]
MSTLVYREGLLPPHENDALVRSQMRLAHRYRNDLVQIERARRAAVRDVARAAPEVARLELEAARTDAACAKVGGQI
KAARAAGRTRKDSVELIEQLKALRIEHKEVVLALREARKTARVAAEPVLAEIEERVAAMRRGARAICGVYWGTYLM
IEDADQAMRKMPLYDKDAEPSDPREVPWTGDGSVGVQIQGGMTGEDTADDTRLRIESAAPPPGADPNSKRSLRRRY
CVLAMRVGSEGRDPVWARWRMVMERPLPADARIKRAAVKLRRVGPREEWSVTITLETAERDRRVSDQVGMVGIDLG
WRLMPDGLRVAAWHGSDGASGELTLPDTRPTFHTTPGGRTRSSALGVVDAARKVEDLSSKRDKAFNEARSAIARIE
GAPPWEELATKTISQWKSQGRLAALVRRWRDARWDGDAEAYEEAEKWRYHDHHLWAWETSQQAKALRARREVERLF
AADMAKRYARLAIEGLDLRAFARKTDDDTNETARRNRVVVAPSKLREALLLAFGSAINHWAETPKGDRVVVEAAG
TTMVHHECGSVERWDQATHVSHLCSSCGEIFDQDANAAKNILAAGERLGGPVLSGAARNDENVSNLSQVREGRWAK
AKRMKAEKDARLEAARKAAPSAAE (SEQ ID NO: 262)

>3300005988|1071091|scaffold06014_8
[wastewater-nutrient removal-wastewater effluent]
MSTLVYREGLLPPHENDALVRSQMRLAHRYRNDLVQIERARRAAVRDVARAAPEVARLELEAARTDAACAKVGGQI
KAARAAGRTRKDSVELIEQLKALRIEHKEVVLALREARKTARVAAEPVLAEIEERVAAMRRGARAICGVYWGTYLM
IEDADQAMRKMPLYDKDAEPSDPREVPWTGDGSVGVQIQGGMTGEDTADDTRLRIESAAPPPGADPNSKRSLRRRY
CVLAMRVGSEGRDPVWARWRMVMERPLPADARIKRAAVKLRRVGPREEWSVTITLETAERDRRVSDQVGMVGIDLG
WRLMPDGLRVAAWHGSDGASGELTLPDTRPTFHTTPGGRTRSSALGVVDAARKVEDLSSKRDKAFNEARSAIARIE
GAPPWEELATKTISQWKSQGRLAALVRRWRDARWDGDAEAYEEAEKWRYHDHHLWAWETSQQAKALRARREVERLF
AADMAKRYARLAIEGLDLRAFARKTDDDTNETARRNRVVVAPSKLREALLLAFGSAINHWAETPKGDRVVVEAAG
TTMVHHECGSVERWDQATHVSHLCSSCGEIFDQDANAAKNILAAGERLGGPVLSGAARNDENVSNLSQVREGRWAK
AKRMKAEKDARLEAARKAAPSAAE (SEQ ID NO: 262)

>3300006056|1071094|scaffold118627_2
[wastewater-nutrient removal-wastewater effluent]
MSTLVYREGLLPPHENDALVRSQMRLAHRYRNDLVQIERARRAAVRDVARAAPEVARLELEAARTDAACAKVGGQI
KAARAAGRTRKDSVELIEQLKALRIEHKEVVLALREARKTARVAAEPVLAEIEERVAAMRRGARAICGVYWGTYLM
IEDADQAMRKMPLYDKDAEPSDPREVPWTGDGSVGVQIQGGMTGEDTADDTRLRIESAAPPPGADPNSKRSLRRRY
CVLAMRVGSEGRDPVWARWRMVMERPLPADARIKRAAVKLRRVGPREEWSVTITLETAERDRRVSDQVGMVGIDLG
WRLMPDGLRVAAWHGSDGASGELTLPDTRPTFHTTPGGRTRSSALGVVDAARKVEDLSSKRDKAFNEARSAIARIE
GAPPWEELATKTISQWKSQGRLAALVRRWRDARWDGDAEAYEEAEKWRYHDHHLWAWETSQQAKALRARREVERLF
AADMAKRYARLAIEGLDLRAFARKTDDDTNETARRNRVVVAPSKLREALLLAFGSAINHWAETPKGDRVVVEAAG
TTMVHHECGSVERWDQATHVSHLCSSCGEIFDQDANAAKNILAAGERLGGPVLSGAARNDENVSNLSQVREGRWAK
AKRMKAEKDARLEAARKAAPSAAE (SEQ ID NO: 262)

* Effector proteins having identical amino acid sequences were identified from different sources and assigned the same sequence identifier.

TABLE 3

Nucleotide Sequences of Representative CLUST.018837 Direct Repeats

| Effector Accession | Direct Repeat Nucleotide Sequence |
| --- | --- |
| WP_081130164.1 (SEQ ID NO: 1) | GTTTCATCGGCCATCGCGGCGGCCTCGTAGCTGCGAC (SEQ ID NO: 27) |
| WP_018079340.1 (SEQ ID NO: 2) | GTTTCATCAGCCATTGCAGGGGCTTTG (SEQ ID NO: 28) |
| WP_064217851.1 (SEQ ID NO: 3) | GTGTTATGCCCATCTCAGCGGGCTGGTTGCTGAGAC (SEQ ID NO: 29) |
| JMEB01000165_11 (SEQ ID NO: 4) | GTTATAGTGGCCATTGTAGGGGCTT (SEQ ID NO: 30) |
| WP_051690567.1 (SEQ ID NO: 5) | GTTATAGTGGCCATTGTAGGGGCTT (SEQ ID NO: 30) |
| OJW42488.1 (SEQ ID NO: 6) | GGTTTAAGGCGATCACGGCCGCCTAGTTGCCGCGAC (SEQ ID NO: 31) |

TABLE 3-continued

Nucleotide Sequences of Representative CLUST.018837 Direct Repeats

| Effector Accession | Direct Repeat Nucleotide Sequence |
|---|---|
| LNFM01018448_6 (SEQ ID NO: 7) | GGTGCTCAAGCCATCGCAGCGGCATCGTTGCTGCGAC (SEQ ID NO: 32) |
| 3300004774\|Ga0007794_10001723_8 (SEQ ID NO: 8) | GAGCGGTTAACAGGGTGTCGATATAGATT (SEQ ID NO: 33) |
| 3300004776\|Ga0007800_10001775_2 (SEQ ID NO: 8) | GAGCGGTTAACAGGGTGTCGATATAGATT (SEQ ID NO: 33) |
| 3300009004\|Ga0100377_1000348_44 (SEQ ID NO: 9) | GTAACAACAGCCATTACCCTGGCTTAGTAAGGGTGAC (SEQ ID NO: 34) |
| 3300004236\|Ga0066449_1000007_83 (SEQ ID NO: 10) | AGTAGAACCCTGTCGCTTGGGCGGTAAAGCGAAC (SEQ ID NO: 35) |
| 3300009432\|Ga0115005_10004282_5 (SEQ ID NO: 11) | GATTAAGGCCCCTGTGCATTGGGGTGTAAATGCAAC (SEQ ID NO: 36) |
| 3300009436\|Ga0115008_10017733_3 (SEQ ID NO: 12) | GTCTAAGGCCCCTGTGCATTGGGGTGTAAATGCAAC (SEQ ID NO: 37) |
| 3300009436\|Ga0115008_10017733_4 (SEQ ID NO: 13) | GTCTAAGGCCCCTGTGCATTGGGGTGTAAATGCAAC (SEQ ID NO: 37) |
| 3300001351\|JGI20153J14318_10007490_6 (SEQ ID NO: 14) | CTTTAAGGACCCTGTACGTTGGGGTGTAAACGTAAC (SEQ ID NO: 38) |
| 3300009447\|Ga0115560_1022222_2 (SEQ ID NO: 15) | CTTTAAGGACCCTGTACGTTGGGGTGTAAACGTAAC (SEQ ID NO: 38) |
| 3300009505\|Ga0115564_10016546_3 (SEQ ID NO: 16) | CTTTAAGGACCCTGTACGTTGGGGTGTAAACGTAAC (SEQ ID NO: 38) |
| 3300020165\|Ga0206125_10004811_3 (SEQ ID NO: 17) | CTTTAAGGACCCTGTACGTTGGGGTGTAAACGTAAC (SEQ ID NO: 38) |
| 3300010313\|Ga0116211_1004493_2 (SEQ ID NO: 18) | GGTATCATGACCCTACGGGTGGGGGG (SEQ ID NO: 39) |
| 3300009784\|Ga0123357_10002363_9 (SEQ ID NO: 19) | AGCCATCGCAGGGGCTTGGTGCTTGCGAC (SEQ ID NO: 40) |
| ADIG01000806_20 (SEQ ID NO: 20) | ATTCCAAGGCGATCACAGCCGCCTAGTAGTTGTGAC (SEQ ID NO: 41) |
| CXWL01128655_18 (SEQ ID NO: 21) | GTTTTAGAACCCTGTTGAGTGGGCATAAACTCAAACT (SEQ ID NO:42) |
| OGCL01001770_13 (SEQ ID NO: 18) | GGTATCATGACCCTACGGATGGGGGG (SEQ ID NO: 43) |
| LNAP01002847_16 (SEQ ID NO: 22) | GATTCATAGCCCTGTCGGTTGGGCGGTAAACCGAAC (SEQ ID NO: 44) |
| 3300007533\|Ga0102944_1000048_72 (SEQ ID NO: 23) | GTCTCAATAGCGATCGGCGCCGCTTAGTAGGGTCGAC (SEQ ID NO: 45) |
| 3300007533\|Ga0102944_1003721_10 (SEQ ID NO: 24) | GGTAACAATAGCGATCGGCGCCGCTTGGTAGTGTCGAC (SEQ ID NO: 46) |
| 3300007533\|Ga0102944_1003721_8 (SEQ ID NO: 25) | GGTAACAATAGCGATCGGCGCCGCTTGGTAGTGTCGAC (SEQ ID NO: 46) |
| APMI01033782_24 (SEQ ID NO: 26) | ATCTCAATGGCCATCGTCGGGGCTTTGTACCGGCGAC (SEQ ID NO: 47) |
| NZ_JQKL01000024_23 (SEQ ID NO: 48) | GTTGCAATGCCTAGCTCAGAGGTTTAAAGACTGAGAC (SEQ ID NO: 263) |
| WP_081908191.1 (SEQ ID NO: 49) | GTTGCAATGCCTAGCTCAGAGGTTTAAAGACTGAGAC (SEQ ID NO: 263) |
| GAB36148.1 (SEQ ID NO: 50) | GTGTCAACGCCAGCGCGGAGGCGTCAAATCCGCGAC (SEQ ID NO: 264) |
| BAFB01000202_4 (SEQ ID NO: 51) | GTGTCAACGCCAGCGCGGAGGCGTCAAATCCGCGAC (SEQ ID NO: 264) |

TABLE 3-continued

Nucleotide Sequences of Representative CLUST.018837 Direct Repeats

| Effector Accession | Direct Repeat Nucleotide Sequence |
|---|---|
| WP_039994403.1 (SEQ ID NO: 52) | GTGTCAACGCCAGCGCGGAGGCGTCAAATCCGCGAC (SEQ ID NO: 264) |
| WP_013159911.1 (SEQ ID NO: 53) | GTAGCAATGCCTAGCTCAGGGGCTT (SEQ ID NO: 265) |
| WP_096876841.1 (SEQ ID NO: 54) | GTTACAAACCCTGCTCATTGGGTTGGTTAATGAGAC (SEQ ID NO: 266) |
| WP_048895525.1 (SEQ ID NO: 55) | GTGAGAATGACCAGCGCACCGGTCGAAAGGTGCGAC (SEQ ID NO: 267) |
| WP_061006603.1 (SEQ ID NO: 56) | GTGTCATAGCCCAGCTTGGCGGGCGAAGGCCAAGAC (SEQ ID NO: 268) |
| WP_011733919.1 (SEQ ID NO: 57) | GTTGACATGCGTGCTCCGCCGCTTTGTAGTGGAGAC (SEQ ID NO: 269) |
| WP_018234394.1 (SEQ ID NO: 58) | TTGATAATGCCCGCTCTGCGGCCTCGTAGTAGAGAC (SEQ ID NO: 270) |
| 33000009441BBAY81_10000005_89 (SEQ ID NO: 59) | CAACGCCTACAGTGGGCTTCGTACATTGTGAC (SEQ ID NO: 271) |
| LSQX01035253_23 (SEQ ID NO: 60) | CAGCGGCCCACGCACGCGAGGGACGGTC (SEQ ID NO: 272) |
| 3300013131\|Ga0172373_10056063_2 (SEQ ID NO: 61) | CAAGCAAGCCTTGCCGAAGAGGCTCGATCTTCGGACG (SEQ ID NO: 273) |
| 3300013136\|Ga0172370_10027535_4 (SEQ ID NO: 62) | ATGATAAGAGTTTCTCGATACTCTATAAATCGAGAC (SEQ ID NO: 274) |
| 3300013137\|Ga0172375_10012175_6 (SEQ ID NO: 63) | CAAGCAAGCCTTGCCGAAGAGGCTCGATCTTCGGAC (SEQ ID NO: 275) |
| 3300010293\|Ga0116204_1010874_1 (SEQ ID NO: 64) | GGTTGAAGCGCCCGCGCAAGGGCTTTGTACTTGCGAC (SEQ ID NO: 276) |
| 3300010293\|Ga0116204_1010874_2 (SEQ ID NO: 65) | GGTTGAAGCGCCCGCGCAAGGGCTTTGTACTTGCGAC (SEQ ID NO: 276) |
| 3300008255\|Ga0100403_1011992_3 (SEQ ID NO: 66) | GTCGCAATGCCAGCCGAACGGCTTGGAAGTTCGGAC (SEQ ID NO: 277) |
| 3300014155\|Ga0181524_10003409_23 (SEQ ID NO: 67) | GTGGCTACGGCATCGCGGCGCCTCGGAGATCGCGAC (SEQ ID NO: 278) |
| 3300014156\|Ga0181518_10000096_28 (SEQ ID NO: 67) | GTGGCTACGGCATCGCGGCGCCTCGGAGATCGCGAC (SEQ ID NO: 278) |
| 3300014158\|Ga0181521_10000063_92 (SEQ ID NO: 67) | GTGGCTACGGCATCGCGGCGCCTCGGAGATCGCGAC (SEQ ID NO: 278) |
| 3300014159\|Ga0181530_10000119_98 (SEQ ID NO: 67) | GTGGCTACGGCATCGCGGCGCCTCGGAGATCGCGAC (SEQ ID NO: 278) |
| 3300014201\|Ga0181537_10003972_13 (SEQ ID NO: 68) | GTCGCAGAGGAAGCTCGACGGATCGAGCGTCGAGAG (SEQ ID NO: 279) |
| 3300014201\|Ga0181537_10021284_1 (SEQ ID NO: 69) | GTCGCGATCGAAGCTCCATCGGCTGGCGATGGAGAC (SEQ ID NO: 280) |
| 3300014201\|Ga0181537_10040512_3 (SEQ ID NO: 70) | CCAGAAAGGGCAGCGCATCGCCCAGGAGAATGCGAC (SEQ ID NO: 281) |
| 3300014654\|Ga0181525_10000532_4 (SEQ ID NO: 71) | GTAGCAACGCCAGCTCGGTTGGTTCTGAGCCGAGACA (SEQ ID NO: 282) |
| 3300014657\|Ga0181522_10000394_52 (SEQ ID NO: 72) | GTGGAAACGTCAATGTCCGGCGGACGACGCTGGAAC (SEQ ID NO: 283) |
| 3300014657\|Ga0181522_10000394_53 (SEQ ID NO: 73) | GTGGAAACGTCAATGTCCGGCGGACGACGCTGGAAC (SEQ ID NO: 283) |
| 3300009175\|Ga0073936_10014029_2 (SEQ ID NO: 74) | CGCTGCAGGGCCTCAAACGACTAGACGAGGCACTGGCAAGCTACGACAAGG (SEQ ID NO: 284) |

TABLE 3-continued

Nucleotide Sequences of Representative CLUST.018837 Direct Repeats

| Effector Accession | Direct Repeat Nucleotide Sequence |
|---|---|
| 3300015360\|Ga0163144_10020017_5 (SEQ ID NO: 75) | CCAACAACGGCTGCTGAGCGCCTT (SEQ ID NO: 285) |
| 3300015360\|Ga0163144_10020017_4 (SEQ ID NO: 76) | CCAACAACGGCTGCTGAGCGCCTT (SEQ ID NO: 285) |
| 3300015360\|Ga0163144_10033243_8 (SEQ ID NO: 77) | GGCTGCTGAGCGCCTTACAAGCTCAGAC (SEQ ID NO: 286) |
| 3300015360\|Ga0163144_10033243_7 (SEQ ID NO: 78) | GGCTGCTGAGCGCCTTACAAGCTCAGAC (SEQ ID NO: 286) |
| 3300015360\|Ga0163144_10062707_6 (SEQ ID NO: 79) | GTAACAACCCCTAGCGCAAGAGGGAAAGCTTGCGAC (SEQ ID NO: 287) |
| 3300015360\|Ga0163144_10062707_6 (SEQ ID NO: 80) | GTAACAACCCCTAGCGCAAGAGGGAAAGCTTGCGAC (SEQ ID NO: 287) |
| 3300020057\|Ga0163151_10006104_16 (SEQ ID NO: 75) | CCAACAGCGGCTGCTGAACGCCTTACAAGTTCAGAC (SEQ ID NO: 288) |
| 3300020186\|Ga0163153_10017638_7 (SEQ ID NO: 81) | CTCACAGTGCCTGCGCAGCGGCTTCGTAGCTGCGAC (SEQ ID NO: 289) |
| 3300020195\|Ga0163150_10003396_14 (SEQ ID NO: 82) | CTCACAGTGCCTGCGCAGCGGCTTCGTAGCTGCGAC (SEQ ID NO: 289) |
| 3300020203\|Ga0163148_10001247_2 (SEQ ID NO: 83) | GTAACAACCCCTAGCGCAAGAGGGAAAGCTTGCGAC (SEQ ID NO: 287) |
| 3300020203\|Ga0163148_10001247_2 (SEQ ID NO: 84) | GTAACAACCCCTAGCGCAAGAGGGAAAGCTTGCGAC (SEQ ID NO: 287) |
| 3300020213\|Ga0163152_10009495_14 (SEQ ID NO: 85) | GTAACAACCCCTAGCGCAAGAGGGAAAGCTTGCGAC (SEQ ID NO: 287) |
| 3300020213\|Ga0163152_10009495_14 (SEQ ID NO: 86) | GTAACAACCCCTAGCGCAAGAGGGAAAGCTTGCGAC (SEQ ID NO: 287) |
| 3300020219\|Ga0163146_10006198_18 (SEQ ID NO: 75) | CCAACAGCGGCTGCTGAACGCCTTACAAGTTCAGAC (SEQ ID NO: 288) |
| 3300020596\|Ga0163149_10010333_13 (SEQ ID NO: 87) | CCAACAACGGCTGCTGAACGCCTTACAAGTTCAGAC (SEQ ID NO: 290) |
| 3300020596\|Ga0163149_10010333_12 (SEQ ID NO: 88) | CCAACAACGGCTGCTGAACGCCTTACAAGTTCAGAC (SEQ ID NO: 290) |
| 3300004174\|Ga0066406_1000030_21 (SEQ ID NO: 89) | GTTGCAATGCCTGCTCATAGGCTTGGTTTATGAGAC (SEQ ID NO: 291) |
| 3300004200\|Ga0066422_1000628_7 (SEQ ID NO: 89) | GTTGCAATGCCTGCTCATAGGCTTGGTTTATGAGAC (SEQ ID NO: 291) |
| 3300004205\|Ga0066415_1000057_23 (SEQ ID NO: 89) | GTTGCAATGCCTGCTCATAGGCTTGGTTTATGAGAC (SEQ ID NO: 291) |
| 3300004565\|Ga0066503_104695_4 (SEQ ID NO: 89) | GTTGCAATGCCTGCTCATAGGCTTGGTTTATGAGAC (SEQ ID NO: 291) |
| 3300009686\|Ga0123338_10029047_2 (SEQ ID NO: 90) | GTAGCAATACCCTAGCTCGAGGGGGTTTGTCGAGAC (SEQ ID NO: 292) |
| 330000124210687J 13896_1000006_134 (SEQ ID NO: 91) | GTTTCAGTATCCTGCTCAGAGGAGTCGTTTCTGAGAC (SEQ ID NO: 293) |
| 3300005236\|Ga0066636_10020712_3 (SEQ ID NO: 92) | GTCGCAATGCCAGCCGAACGGCTTGGAAGTTCGGAC (SEQ ID NO: 277) |
| 3300014208\|Ga0172379_10007070_15 (SEQ ID NO: 93) | GCGACGACAACGGCAGCTCATCGCCACGAAAGATGAGAC (SEQ ID NO: 294) |
| 3300014208\|Ga0172379_10014650_2 (SEQ ID NO: 94) | GTGCAGGGCTGTCGAACCTGCGA (SEQ ID NO: 295) |

TABLE 3-continued

Nucleotide Sequences of Representative CLUST.018837 Direct Repeats

| Effector Accession | Direct Repeat Nucleotide Sequence |
|---|---|
| 3300014613\|Ga0180008_1000021_8 (SEQ ID NO: 95) | GCTGGGATGTTTAGTGATC (SEQ ID NO: 296) |
| 3300014613\|Ga0180008_1000021_9 (SEQ ID NO: 96) | GCTGGGATGTTTAGTGATC (SEQ ID NO: 296) |
| 3300014656\|Ga0180007_10000195_44 (SEQ ID NO: 95) | GCTGGGAGGTTTAGTGATCCCAGAC (SEQ ID NO: 297) |
| 3300014656\|Ga0180007_10000195_48 (SEQ ID NO: 96) | GCTGGGAGGTTTAGTGATCCCAGAC (SEQ ID NO: 297) |
| 3300014656\|Ga0180007_10004731_7 (SEQ ID NO: 97) | GTCACAATGCCTGCGCAGAGGCTTTGTTTCTGCGACG (SEQ ID NO: 298) |
| 3300014656\|Ga0180007_10004731_5 (SEQ ID NO: 98) | GTCACAATGCCTGCGCAGAGGCTTTGTTTCTGCGACG (SEQ ID NO: 298) |
| 3300015370\|Ga0180009_10002661_7 (SEQ ID NO: 99) | GTATCAATGCCTGCTCAAGGGCTTTGTGCTTGAGAC (SEQ ID NO: 299) |
| 3300009760\|Ga0116131_1003961_2 (SEQ ID NO: 100) | CTCGCAATGCCAGCCCAGAGGCGGATGTTCTGGGAC (SEQ ID NO: 300) |
| 3300018019\|Ga0187874_10017489_1 (SEQ ID NO: 101) | CTTTCAAGACGAGCGGAAGCGTCTGCTTCTTCCGAC (SEQ ID NO: 301) |
| 3300018025\|Ga0187885_10005575_2 (SEQ ID NO: 102) | ATCGAAGAGCCTGCTCAGGGGCTTTGTTCTTGAGAC (SEQ ID NO: 302) |
| 3300018025\|Ga0187885_10005575_1 (SEQ ID NO: 103) | ATCGAAGAGCCTGCTCAGGGGCTTTGTTCTTGAGAC (SEQ ID NO: 302) |
| 3300018057\|Ga0187858_10035455_2 (SEQ ID NO: 104) | CTTTCAAGACGAGCGGAAGCGTCTGCTTCTTCCG (SEQ ID NO: 303) |
| 3300012183\|Ga0136624_1011435_1 (SEQ ID NO: 105) | TAAGTGTCAGTGCCTGCGCACCGG (SEQ ID NO: 304) |
| 3300012682\|Ga0136611_10000100_4 (SEQ ID NO: 106) | CAAACAATGCCCGCGCAGTGGGCTTCGTCACTGCGAC (SEQ ID NO: 305) |
| 3300013127\|Ga0172365_10004082_5 (SEQ ID NO: 107) | GTAGTAACGCCCGCGAACAGGCTTCGTTTGTTCGAC (SEQ ID NO: 306) |
| 3300013127\|Ga0172365_10004082_3 (SEQ ID NO: 108) | GTAGTAACGCCCGCGAACAGGCTTCGTTTGTTCGAC (SEQ ID NO: 306) |
| 3300013127\|Ga0172365_10033732_1 (SEQ ID NO: 109) | CGTTGCAAGGGCTGCGCGACACCCTGGAAGTCGCGAC (SEQ ID NO: 307) |
| 3300013128\|Ga0172366_10016188_4 (SEQ ID NO: 107) | GTAGTAACGCCCGCGAACAGGCTTCGTTTGTTCGAC (SEQ ID NO: 306) |
| 3300013128\|Ga0172366_10018111_5 (SEQ ID NO: 110) | GTCGCAATGGGCGCTCACCCCCCTTGTAAGTGAGAC (SEQ ID NO: 308) |
| 3300013129\|Ga0172364_10001281_26 (SEQ ID NO: 111) | GTGGCAAAGGCATCGAATCGCCTGAGAAGATTCGAC (SEQ ID NO: 309) |
| 3300013129\|Ga0172364_10017363_4 (SEQ ID NO: 107) | AACGCCTGCGAACAGGCTTCGTTTGTTCGAC (SEQ ID NO: 310) |
| 3300013129\|Ga0172364_10018773_2 (SEQ ID NO: 112) | GTCGCAATGGGCGCTCACCCCCCTTGTAAGTGAGAC (SEQ ID NO: 311) |
| 3300013129\|Ga0172364_10045136_2 (SEQ ID NO: 113) | GTTGCAAGGGCTGCGCGACACCCTGGAAGTCGCGAC (SEQ ID NO: 312) |
| 3300013130\|Ga0172363_10000480_22 (SEQ ID NO: 111) | GTGGCAAAGGCATCGAATCGCCTGAGAAGATTCGAC (SEQ ID NO: 309) |
| 3300013130\|Ga0172363_10009486_8 (SEQ ID NO: 114) | AACGCCTGCGAACAGGCTTCGTTTGTTCGAC (SEQ ID NO: 310) |

TABLE 3-continued

Nucleotide Sequences of Representative CLUST.018837 Direct Repeats

| Effector Accession | Direct Repeat Nucleotide Sequence |
|---|---|
| 3300013130\|Ga0172363_10014785_2 (SEQ ID NO: 115) | GGGTGGCAGTGCCTGCTCAGAGGCTTAGTATCTGTGACA (SEQ ID NO: 313) |
| 3300013133\|Ga0172362_10012573_3 (SEQ ID NO: 107) | AACGCCTGCGAACAGGCTTCGTTTGTTCGAC (SEQ ID NO: 310) |
| 3300013133\|Ga0172362_10022806_8 (SEQ ID NO: 115) | TGTGGCAGTGCCTGCTCAGAGGCTTAGTATCTGTGACA (SEQ ID NO: 314) |
| 3300013133\|Ga0172362_10025871_2 (SEQ ID NO: 113) | GTTGCAAGGGTTGCGCGACACCCTGGAAGTCGCGAC (SEQ ID NO: 315) |
| 3300010155\|Ga0098047_10009758_2 (SEQ ID NO: 116) | GTGCAAATGCCCGCACAGAGGCTTAGTGTCTGTGAC (SEQ ID NO: 316) |
| 3300006805\|Ga0075464_10026824_2 (SEQ ID NO: 117) | GTCACAACGCCCGCGCAGGGGCTTGGTATCTGCGAC (SEQ ID NO: 317) |
| 3300006805\|Ga0075464_10026824_2 (SEQ ID NO: 118) | GTCACAACGCCCGCGCAGGGGCTTGGTATCTGCGAC (SEQ ID NO: 317) |
| 3300009149\|Ga0114918_10020022_2 (SEQ ID NO: 119) | CTTTCAAAGCTTGCTCGTTAGCTTTATGAACGAGAC (SEQ ID NO: 318) |
| 3300006083\|Ga0081762_1007854_6 (SEQ ID NO: 120) | GTTTGAAAGCAGCTATAGAGGGCAGAAAC (SEQ ID NO: 319) |
| 3300010354\|Ga0129333_10000304_8 (SEQ ID NO: 121) | GCAAGGGCTGCTCAGGGCCCTGGAATCTGAGAC (SEQ ID NO: 320) |
| 3300010354\|Ga0129333_10000304_10 (SEQ ID NO: 122) | GCAAGGGCTGCTCAGGGCCCTGGAATCTGAGAC (SEQ ID NO: 320) |
| 3300009507\|Ga0115572_10029017_2 (SEQ ID NO: 123) | ATTTAATGACCCTGCGTGTTGGGGTGTGAACACGAC (SEQ ID NO: 321) |
| 3300017963\|Ga0180437_10000100_151 (SEQ ID NO: 124) | CTTACAATACCTGCGAGACGGTTTAGAAGTCTCGAC (SEQ ID NO: 322) |
| 3300017963\|Ga0180437_10000153_25 (SEQ ID NO: 125) | CCTTCAATCCCTGCGAGACGGGTTAGAAGTCTCGAC (SEQ ID NO: 323) |
| 3300017963\|Ga0180437_10000488_78 (SEQ ID NO: 126) | GTAACAACACCAGTCCAAAGGTTTATGATTTGGAAC (SEQ ID NO: 324) |
| 3300017963\|Ga0180437_10000692_13 (SEQ ID NO: 127) | CTCGCGGTCCCATCGGAACGGGTTGTGGTTCCGACA (SEQ ID NO: 325) |
| 3300017963\|Ga0180437_10006965_20 (SEQ ID NO: 128) | GTCTCAACGCCTACTCAGGGGCTTTGT (SEQ ID NO: 326) |
| 3300017963\|Ga0180437_10006965_20 (SEQ ID NO: 129) | GTCTCAACGCCTACTCAGGGGCTTTGT (SEQ ID NO: 326) |
| 3300017963\|Ga0180437_10073069_2 (SEQ ID NO: 130) | CTTGCAACGGCAGCGTACCGCCTTCAAGTGTGCGAC (SEQ ID NO: 327) |
| 3300017971\|Ga0180438_10000090_91 (SEQ ID NO: 125) | CCTTCAATCCCTGCGAGACGGGTTAGAAGTCTCGAC (SEQ ID NO: 323) |
| 3300017971\|Ga0180438_10000124_114 (SEQ ID NO: 127) | CTCGCGGTCCCATCGGAACGGGTTGTGGTTCCGACA (SEQ ID NO: 325) |
| 3300017971\|Ga0180438_10000195_144 (SEQ ID NO: 124) | CTTACAATACCTGCGAGACGGTTTAGAAGTCTCGAC (SEQ ID NO: 322) |
| 3300017971\|Ga0180438_10013386_7 (SEQ ID NO: 126) | GTAACAACACCAGTCCAAAGGTTTATGATTTGGAAC (SEQ ID NO: 324) |
| 3300017971\|Ga0180438_10021273_1 (SEQ ID NO: 131) | GTCTCAACGCCTACTCAGGGGCTTTGT (SEQ ID NO: 326) |
| 3300017971\|Ga0180438_10044179_5 (SEQ ID NO: 132) | CCTTGCAACGGCAGCGTACCGCCTTCAAGTGTGCGAC (SEQ ID NO: 328) |

TABLE 3-continued

Nucleotide Sequences of Representative CLUST.018837 Direct Repeats

| Effector Accession | Direct Repeat Nucleotide Sequence |
|---|---|
| 3300017971\|Ga0180438_10056790_2 (SEQ ID NO: 133) | CCGGGAACAGCCGCGCAGGGGCTTGGTGCCTGCGAC (SEQ ID NO: 329) |
| 3300017971\|Ga0180438_10072596_2 (SEQ ID NO: 134) | CGTCGCAACGCCTGCGGAGAGGCCTTGTTTCTCCGACGG (SEQ ID NO: 330) |
| 3300017987\|Ga0180431_10022214_3 (SEQ ID NO: 135) | GTTTCAGACCCATCGCAAGGGGTTATAGCTTGCGAC (SEQ ID NO: 331) |
| 3300017987\|Ga0180431_10041976_5 (SEQ ID NO: 136) | GTCGCAACGCCTGCGGAGAGGCCTTGTTTCTCCGAC (SEQ ID NO: 332) |
| 3300017989\|Ga0180432_10002388_5 (SEQ ID NO: 135) | GTTTCAGACCCATCGCAAGGGGTTATAGCTTGCGAC (SEQ ID NO: 331) |
| 3300017989\|Ga0180432_10021155_3 (SEQ ID NO: 137) | GTTGCAAAGCCATCTCCAGGGTTTGGTGCTGGAGAC (SEQ ID NO: 333) |
| 3300017989\|Ga0180432_10021155_5 (SEQ ID NO: 138) | GTTGCAAAGCCATCTCCAGGGTTTGGTGCTGGAGAC (SEQ ID NO: 333) |
| 3300017989\|Ga0180432_10043261_1 (SEQ ID NO: 139) | GTTGGAATGCCTGTGGAAAGGCTTTGTATTTCCAAC (SEQ ID NO: 334) |
| 3300017989\|Ga0180432_10045094_6 (SEQ ID NO: 140) | AGCAATGCGAGCGCAGACGCTTCGTATCTGCGAC (SEQ ID NO: 335) |
| 3300017991\|Ga0180434_10002646_1 (SEQ ID NO: 135) | GTTTCAGACCCATCGCAAGGGGTTATAGCTTGCGAC (SEQ ID NO: 331) |
| 3300017991\|Ga0180434_10013735_9 (SEQ ID NO: 141) | GTCACAACGCCTGCGCAAGGGCTTTGTTATTGCGAC (SEQ ID NO: 336) |
| 3300017992\|Ga0180435_10018121_11 (SEQ ID NO: 142) | CTTCCAATACCTGCGAGACGGTTTAGAAGTCTCGACG (SEQ ID NO: 337) |
| 3300018065\|Ga0180430_10011859_2 (SEQ ID NO: 143) | GGAGCAATGCCTGCACGAGGGCTTTGTGCTCGTGAC (SEQ ID NO: 338) |
| 3300018065\|Ga0180430_10038979_3 (SEQ ID NO: 144) | GTCGCAACGCCTGCGCGGAGGCTTTGTTTCCGCGAC (SEQ ID NO: 339) |
| 3300018080\|Ga0180433_10006034_17 (SEQ ID NO: 145) | ATGGAAATGCCATTACAAAGGTTTAGGATTTGTAAC (SEQ ID NO: 340) |
| 3300018080\|Ga0180433_10006034_18 (SEQ ID NO: 146) | ATGGAAATGCCATTACAAAGGTTTAGGATTTGTAAC (SEQ ID NO: 340) |
| 3300018080\|Ga0180433_10012134_6 (SEQ ID NO: 147) | TGTCGCAAAGCCATCTCCAAGGCTTGGTG (SEQ ID NO: 341) |
| 3300018080\|Ga0180433_10012134_6 (SEQ ID NO: 148) | TGTCGCAAAGCCATCTCCAAGGCTTGGTG (SEQ ID NO: 341) |
| 3300018080\|Ga0180433_10020043_6 (SEQ ID NO: 149) | CTCGCAATCGAAGCTCCGCCCGTTGTAGGCGGAGAC (SEQ ID NO: 342) |
| 3300018080\|Ga0180433_10021337_5 (SEQ ID NO: 150) | GTCACAACGCCTGCGCAAGGGCTTTGTTATTGCGAC (SEQ ID NO: 336) |
| 3300018080\|Ga0180433_10021840_7 (SEQ ID NO: 151) | TGGAAGAGCCATCGCAATGGCTTCGGATTGCGAC (SEQ ID NO: 343) |
| 3300018080\|Ga0180433_10021840_7 (SEQ ID NO: 152) | TGGAAGAGCCATCGCAATGGCTTCGGATTGCGAC (SEQ ID NO: 343) |
| 3300001256\|JGI12210J13797_10495608_9 (SEQ ID NO: 153) | CACGAAAAGGCAGCTCGATGCCTTACAAATCGAGAC (SEQ ID NO: 344) |
| 3300001256\|JGI12210J13797_10495610_14 (SEQ ID NO: 153) | CACGAAAAGGCAGCTCGATGCCTTACAAATCGAGAC (SEQ ID NO: 344) |
| 3300005917\|Ga0075115_10002831_4 (SEQ ID NO: 154) | AGAAATGGTTGTGAAATGCCTTTAAAATTTCAAC (SEQ ID NO: 345) |

TABLE 3-continued

Nucleotide Sequences of Representative CLUST.018837 Direct Repeats

| Effector Accession | Direct Repeat Nucleotide Sequence |
|---|---|
| 3300005918\|Ga0075116_10002890_7 (SEQ ID NO: 155) | ACAGAAATGGTAGTGGAATGCCTTTAAAATT (SEQ ID NO: 346) |
| 3300011414\|Ga0137442_1000121_10 (SEQ ID NO: 156) | GCCACAGCACCTGCTCGAACGGTTCGAGTTCGAGAC (SEQ ID NO: 347) |
| 3300011431\|Ga0137438_1001223_2 (SEQ ID NO: 156) | GCCACAGCACCTGCTCGAACGGTTCGAGTTCGAGAC (SEQ ID NO: 347) |
| 3300011441\|Ga0137452_1000071_9 (SEQ ID NO: 157) | CTGAAAACGCCAGCGCGAAGGCTTCATATTCGCGAC (SEQ ID NO: 348) |
| 3300006855\|Ga0079044_1002244_2 (SEQ ID NO: 158) | GTGCAAGAGCCTGCGCCGAGGCGTCGTATCGGCGACA (SEQ ID NO: 349) |
| 3300006855\|Ga0079044_1002244_2 (SEQ ID NO: 159) | GTGCAAGAGCCTGCGCCGAGGCGTCGTATCGGCGACA (SEQ ID NO: 349) |
| 3300009503\|Ga0123519_10000481_19 (SEQ ID NO: 160) | GTGGAAAGGGTATCTCTGGACCTTACAATCAGAGAC (SEQ ID NO: 350) |
| 3300009503\|Ga0123519_10000481_22 (SEQ ID NO: 161) | GTGGAAAGGGTATCTCTGGACCTTACAATCAGAGAC (SEQ ID NO: 350) |
| 3300006865\|Ga0073934_10032691_1 (SEQ ID NO: 162) | GCCGCAACGCCTGTGGAAGGGC (SEQ ID NO: 351) |
| 3300001340\|JGI20133J14441_1002607_2 (SEQ ID NO: 163) | GGTGCAGCGGTTGCTCAGCACCGTAGAAGCTGAGAG (SEQ ID NO: 352) |
| 3300009784\|Ga0123357_10000018_105 (SEQ ID NO: 164) | CCCGTGCCCGTCTCCGTCTCC (SEQ ID NO: 353) |
| 3300009784\|Ga0123357_10000074_42 (SEQ ID NO: 165) | GATCGCGACGGCGACGGTATCC (SEQ ID NO: 354) |
| 3300009784\|Ga0123357_10000076_32 (SEQ ID NO: 166) | GGCGTCCGCCAGCGTCGGGGCAACCACACCGACGAC (SEQ ID NO: 355) |
| BBPF01004549_6 (SEQ ID NO: 167) | GTTGCAGTGCCCAGCTCAGGGGCTTGATAACTGAGAC (SEQ ID NO: 356) |
| BBPG01001333_4 (SEQ ID NO: 167) | GTTGCAGTGCCCAGCTCAGGGGCTTGATAACTGAGAC (SEQ ID NO: 356) |
| OGZV01009429_1 (SEQ ID NO: 168) | TAGTGAGTTTAGCACATTTCTAAAAC (SEQ ID NO: 357) |
| OKWZ01000119_10 (SEQ ID NO: 169) | GTTTAAGTAGTAGTGAGTTTAGCACATCTCTAAAAC (SEQ ID NO: 358) |
| ODGR01000476_16 (SEQ ID NO: 170) | TTAAGTAGTAGTGAGTTTAGCATATTTCTAAAACG (SEQ ID NO: 359) |
| ODIG01000268_14 (SEQ ID NO: 169) | GTTTAAGTAGTAGTGAGTTTAGCACATCTCTAAAAC (SEQ ID NO: 358) |
| ODIP01002140_2 (SEQ ID NO: 171) | TAAGTAATAGTGAGTTTAGCACATCTCTAAAAC (SEQ ID NO: 360) |
| ODIW01000227_18 (SEQ ID NO: 171) | TTAAGTAATAGTGAGTTTAGCACATCTCTAAAAC (SEQ ID NO: 361) |
| ODJA01000260_38 (SEQ ID NO: 169) | GTTTAAGTAGTAGTGAGTTTAGCACATCTCTAAAAC (SEQ ID NO: 358) |
| ODJP01000229_55 (SEQ ID NO: 169) | GTTTAAGTAGTAGTGAGTTTAGCACATCTCTAAAAC (SEQ ID NO: 358) |
| ODKZ01007116_1 (SEQ ID NO: 172) | TTAAGTAGTAGTGAGTTTAGCATATTTCTAAAACG (SEQ ID NO: 359) |
| ODM001000523_12 (SEQ ID NO: 169) | GTTTAAGTAGTAGTGAGTTTAGCACATCTCTAAAAC (SEQ ID NO: 358) |

TABLE 3-continued

Nucleotide Sequences of Representative CLUST.018837 Direct Repeats

| Effector Accession | Direct Repeat Nucleotide Sequence |
|---|---|
| ODIN01000195_35 (SEQ ID NO: 169) | GTTTAAGTAGTAGTGAGTTTAGCACATCTCTAAAAC (SEQ ID NO: 358) |
| ODOP01000194_18 (SEQ ID NO: 172) | GGTTAAGTAGTAGTGAGTTTAGCACATCTCTAAAAC (SEQ ID NO: 362) |
| ODWI01002981_3 (SEQ ID NO: 169) | GTTTAAGTAGTAGTGAGTTTAGCACATTTCTA (SEQ ID NO: 363) |
| ODZZ01005262_2 (SEQ ID NO: 169) | GTTTAAGTAGTAGTGAGTTTAGCACATCTCTAAAAC (SEQ ID NO: 358) |
| OEED01000500_25 (SEQ ID NO: 173) | TAAGTAATAGTGAGTTTAGCACATCTCTAAAAC (SEQ ID NO: 360) |
| OEFT01000529_3 (SEQ ID NO: 169) | GTTTAAGTAGTAGTGAGTTTAGCACATCTCTAAAAC (SEQ ID NO: 358) |
| LAZR01002400_15 (SEQ ID NO: 174) | GTAGCAATGGCAGCGCATCGCCTTTTAAGATGCGAC (SEQ ID NO: 364) |
| LAZR01002400_19 (SEQ ID NO: 175) | GTAGCAATGGCAGCGCATCGCCTTTTAAGATGCGAC (SEQ ID NO: 364) |
| FLSK01003024_2 (SEQ ID NO: 169) | GTTTAAGTAGTAGTGAGTTTAGCACATCTCTAAAAC (SEQ ID NO: 358) |
| OFLM01000072_9 (SEQ ID NO: 176) | TAATGAGTTTAGCATATCTCTAAAAC (SEQ ID NO: 365) |
| OFLO01000090_50 (SEQ ID NO: 176) | TGAGTTTAGCATATCTCTAAAAC (SEQ ID NO: 366) |
| OFLU01000140_22 (SEQ ID NO: 177) | GGTTAAGTAGTAGTGAGTTTAGCATATCTCTAAAAC (SEQ ID NO: 367) |
| OFLV01000230_3 (SEQ ID NO: 177) | GGTTAAGTAGTAGTGAGTTTAGCATATCTCTAAAAC (SEQ ID NO: 367) |
| OGCY01000078_30 (SEQ ID NO: 178) | GGTTAAGTAGTAGTGAGTTTAGCACATCTCTAAAAC (SEQ ID NO: 362) |
| OGJO01000473_2 (SEQ ID NO: 169) | GTTTAAGTAGTAGTGAGTTTAGCACATCTCTAAAAC (SEQ ID NO: 358) |
| OGJI01000109_37 (SEQ ID NO: 179) | GGTTAAATAGTAGTGAGTTTAGCACATCTCTAAAAC (SEQ ID NO: 368) |
| OGJZ01005194_5 (SEQ ID NO: 180) | GGTTAAGTAGTAGTGAGTTTAGCATATCTCTAAAAC (SEQ ID NO: 367) |
| OGKO01001669_8 (SEQ ID NO: 181) | GGTTAAGTAGTAGTGAGTTTAGCACATCTCTAAAAC (SEQ ID NO: 362) |
| OFCI01000292_37 (SEQ ID NO: 182) | GTAACAGAGGCTGCTCAATGCCTTTGAAATTGAGAC (SEQ ID NO: 369) |
| 3300006048\|Ga0075363_100000001_25 (SEQ ID NO: 183) | GTAACAATCCCAGTGCAACGGGTTAGTAGTTGCAAC (SEQ ID NO: 370) |
| 3300006048\|Ga0075363_100000001_20 (SEQ ID NO: 184) | GTAACAATCCCAGTGCAACGGGTTAGTAGTTGCAAC (SEQ ID NO: 370) |
| 3300006048\|Ga0075363_100000020_49 (SEQ ID NO: 185) | GTGTGGAGGCAGCTCGGTGCCGATGGAAACTGAGAC (SEQ ID NO: 371) |
| 3300006178\|Ga0075367_10000108_6 (SEQ ID NO: 183) | GTAACAATCCCAGTGCAACGGGTTAGTAGTTGCAAC (SEQ ID NO: 370) |
| 3300006178\|Ga0075367_10000108_6 (SEQ ID NO: 184) | GTAACAATCCCAGTGCAACGGGTTAGTAGTTGCAAC (SEQ ID NO: 370) |
| 3300006195\|Ga0075366_10000160_13 (SEQ ID NO: 183) | GTAACAATCCCAGTGCAACGGGTTAGTAGTTGCAAC (SEQ ID NO 370) |
| 3300009500\|Ga0116229_10010095_9 (SEQ ID NO: 186) | CTTGCAATGGCTGCGCAGGGCCTTGGACGCTGCGAC (SEQ ID NO: 372) |

TABLE 3-continued

Nucleotide Sequences of Representative CLUST.018837 Direct Repeats

| Effector Accession | Direct Repeat Nucleotide Sequence |
|---|---|
| 3300009701\|Ga0116228_10018148_5 (SEQ ID NO: 187) | TCGAATTCGGTTGACGCT (SEQ ID NO: 373) |
| 33000055771G a0068857_100000008_1 97 (SEQ ID NO: 188) | GTTGGCAATAGAAGCTAACCTCTATAAGCGTTAGACC (SEQ ID NO: 374) |
| 3300005338\|Ga0068868_100030384_5 (SEQ ID NO: 189) | GTGGAGAGGCCAGCGCAGGGGCTTTGTGCCTGCGAC (SEQ ID NO: 375) |
| 3300005841\|Ga0068863_100041042_2 (SEQ ID NO: 190) | GTTGAAAACCCCATCGATTCGGGGTAGTG (SEQ ID NO: 376) |
| 3300013306\|Ga0163162_10000022_15 3 (SEQ ID NO: 191) | CTCGCAAGCGTTGCTCGACACGCTAGGTGTCGAGAC (SEQ ID NO: 377) |
| 3300009148\|Ga0105243_10000126_60 (SEQ ID NO: 192) | TCGTCCTGCAGCGTGATCCCGCC (SEQ ID NO: 378) |
| 3300006846\|Ga0075430_100000057_6 7 (SEQ ID NO: 193) | GCCGTCGAAATGCCTGCTCGGGGGCTTCGTACCTGAGAC (SEQ ID NO: 379) |
| 3300006853\|Ga0075420_100000070_3 (SEQ ID NO: 193) | GCCGTCGAAATGCCTGCTCGGGGGCTTCGTACCTGAGAC (SEQ ID NO: 379) |
| 3300006854\|Ga0075425_100000037_5 7 (SEQ ID NO: 185) | GTGTGGAGGCAGCTCGGTGCCGATGGAAACTGAGAC (SEQ ID NO: 371) |
| 3300006903\|Ga0075426_10000611_28 (SEQ ID NO: 194) | AAGAGCATCCCGGGCGCGAA (SEQ ID NO: 380) |
| 3300006914\|Ga0075436_100000782_9 (SEQ ID NO: 194) | AAGAGCATCCCGGGCGCGAA (SEQ ID NO: 380) |
| 3300007076\|Ga0075435_100000061_4 7 (SEQ ID NO: 194) | AAGAGCATCCCGGGCGCGAA (SEQ ID NO: 380) |
| 3300007076\|Ga0075435_100000750_2 9 (SEQ ID NO: 185) | GTGTGGAGGCAGCTCGGTGCCGATGGAAACTGAGAC (SEQ ID NO: 371) |
| 3300009100\|Ga0075418_10076301_2 (SEQ ID NO: 195) | GTAGGAACCCCTAGTGTCCTGGGTGGAGAGGACAAC (SEQ ID NO: 381) |
| 3300009100\|Ga0075418_10076301_2 (SEQ ID NO: 196) | GTAGGAACCCCTAGTGTCCTGGGTGGAGAGGACAAC (SEQ ID NO: 381) |
| 3300009156\|Ga0111538_10081463_8 (SEQ ID NO: 197) | GCGCGGGGGCTTGGTTCCTGCGAC (SEQ ID NO: 382) |
| 3300005548\|Ga0070665_100000073_1 73 (SEQ ID NO: 198) | GAAACAAAGCGTGCTCTGCCGCTTGGAAGCAGAGAC (SEQ ID NO: 383) |
| OBLM01000011_1 (SEQ ID NO: 199) | CGTGACGATGGTTGCTCG (SEQ ID NO: 384) |
| OCTA010000646_37 (SEQ ID NO: 200) | AATCCCTGCTCAAGAGGGTGTGTCTTGAGAC (SEQ ID NO: 385) |
| ODAK010001378_33 (SEQ ID NO: 201) | CTCGCAATCGTTGCTGGACGGACTTCTCGTTCAGAC (SEQ ID NO: 386) |
| ODAK010029943_5 (SEQ ID NO: 202) | GTCGAAATGCCCGCTCAGCGGCTTAGTTGCTGAGAC (SEQ ID NO: 387) |
| ODAK010029943_6 (SEQ ID NO: 203) | GTCGAAATGCCCGCTCAGCGGCTTAGTTGCTGAGAC (SEQ ID NO: 387) |
| 3300005602\|Ga0070762_10000001_34 (SEQ ID NO: 204) | GTCGAGATCAGGCTCCATGAGATCGACCATGGAGAC (SEQ ID NO: 388) |
| 3300005602\|Ga0070762_10000001_32 (SEQ ID NO: 205) | GTCGAGATCAGGCTCCATGAGATCGACCATGGAGAC (SEQ ID NO: 388) |
| 3300006796\|Ga0066665_10000988_15 (SEQ ID NO: 206) | GGTGACAAAGCCCTGTGCAGCGGGCTCAAAGCTGCGAC (SEQ ID NO: 389) |

TABLE 3-continued

Nucleotide Sequences of Representative CLUST.018837 Direct Repeats

| Effector Accession | Direct Repeat Nucleotide Sequence |
| --- | --- |
| 3300018429\|Ga0190272_10000030_113 (SEQ ID NO: 207) | GTCGCAACGCCTGCGTCGGGGCCTCGTGCCGACGAC (SEQ ID NO: 390) |
| 3300018432\|Ga0190275_10000082_154 (SEQ ID NO: 208) | GCAATGGCTGCTCAGCGCCCTTGAAGCTGAGAC (SEQ ID NO: 391) |
| 3300018481\|Ga0190271_10027355_3 (SEQ ID NO: 209) | AGCCTGCGCGGTGGCTGAGGACCGCGAC (SEQ ID NO: 392) |
| 3300019874\|Ga0193744_1000265_21 (SEQ ID NO: 210) | GTGTGGAGGCTGCTCAAGGCCGATGGAACTTGAGAC (SEQ ID NO: 393) |
| 3300020021\|Ga0193726_1013919_1 (SEQ ID NO: 211) | GGTGGCACGAGTTGCTCGGCGCTCTACGAGCCGAGAC (SEQ ID NO: 394) |
| 3300020021\|Ga0193726_1013919_1 (SEQ ID NO: 212) | GGTGGCACGAGTTGCTCGGCGCTCTACGAGCCGAGAC (SEQ ID NO: 394) |
| 3300020034\|Ga0193753_10002988_10 (SEQ ID NO: 213) | AACATCTGCTCGATCGATCCGAGATCGAGCC (SEQ ID NO: 395) |
| 3300020034\|Ga0193753_10002988_9 (SEQ ID NO: 214) | AACATCTGCTCGATCGATCCGAGATCGAGCC (SEQ ID NO: 395) |
| 3300020156\|Ga0196970_1000866_40 (SEQ ID NO: 215) | TGGAAACCCTGCGCAGGGGGTTAAAGCCTGCGAC (SEQ ID NO: 396) |
| 3300020579\|Ga0210407_10000200_14 (SEQ ID NO: 216) | GTCTCAATGGCTGCGACGAGCCGTGCAATCGTCGAC (SEQ ID NO: 397) |
| 3300020580\|Ga0210403_10000550_35 (SEQ ID NO: 216) | GTCTCAATGGCTGCGACGAGCCGTGCAATCGTCGAC (SEQ ID NO: 397) |
| 3300020580\|Ga0210403_10001296_17 (SEQ ID NO: 217) | CGCAAGCATTCGTCACAATCA (SEQ ID NO: 398) |
| 3300020581\|Ga0210399_10010852_9 (SEQ ID NO: 218) | GTTGTAGAGGTAACGAAGCACCTGAAAGACTTCGAG (SEQ ID NO: 399) |
| 3300020583\|Ga0210401_10033176_5 (SEQ ID NO: 217) | GGTAGCGAAACACCTTGAAG (SEQ ID NO: 400) |
| 3300005435\|Ga0070714_100002341_12 (SEQ ID NO: 219) | GTGGAAAAGAGCAGCGCGGGGCTCCAACGCCGCGAC (SEQ ID NO: 401) |
| 3300009095\|Ga0079224_100000262_28 (SEQ ID NO: 220) | GCTGCAAAGGACGTGGCGTTCCTTGAACACGCCAAC (SEQ ID NO: 402) |
| 3300009095\|Ga0079224_100170797_3 (SEQ ID NO: 221) | GTTGCAATGCCGACTCCGCGGCTTGGTTGCGGAGAGG (SEQ ID NO: 403) |
| 3300010343\|Ga0074044_10013672_1 (SEQ ID NO: 222) | GTCGCAGGTGATGCTCTGAGGCTTTGGATCGGAGAC (SEQ ID NO: 404) |
| 3300010343\|Ga0074044_10041345_4 (SEQ ID NO: 223) | GTGGAAAGGGCAGCGCAGAGCCCGTGATGCTGCGAC (SEQ ID NO: 405) |
| 3300005468\|Ga0070707_100000083_12 (SEQ ID NO: 224) | CGGCGTGCCCTCGTCCTGCACCGTGATCCCGGC (SEQ ID NO: 406) |
| 3300006163\|Ga0070715_10000067_44 (SEQ ID NO: 225) | GCGACTGCGTTTGCTCGGTGACGGGTTCACCGAGAC (SEQ ID NO: 407) |
| 3300014498\|Ga0182019_10003703_1 (SEQ ID NO: 226) | GTAACAATGCCAGCCCAGAGGCAAAGGTTCTGGGAC (SEQ ID NO: 408) |
| 3300001131\|JGI12631J13338_100029613 (SEQ ID NO: 227) | GTGCAGCCCCTGGGCACGTGGGCGACGG (SEQ ID NO: 409) |
| 33000015931JG I12635J15846_10002852_1 (SEQ ID NO: 227) | GTGCAGCCCCTGGGCACGTGGGCGACGG (SEQ ID NO: 409) |
| 3300009813\|Ga0105057_1000075_5 (SEQ ID NO: 228) | GATCACACGGCGACCTCCGCCGCCTCGAAGCGGAGAC (SEQ ID NO: 410) |

TABLE 3-continued

Nucleotide Sequences of Representative CLUST.018837 Direct Repeats

| Effector Accession | Direct Repeat Nucleotide Sequence |
|---|---|
| 3300009813\|Ga0105057_1000075_5 (SEQ ID NO: 229) | GATCACACGGCGACCTCCGCCGCCTCGAAGCGGAGAC (SEQ ID NO: 410) |
| 3300014489\|Ga0182018_10031574_1 (SEQ ID NO: 230) | CTCACAACGGCAGCGAGGCGCCTTGGAGTCCTCGAC (SEQ ID NO: 411) |
| 3300014501\|Ga0182024_10047267_8 (SEQ ID NO: 231) | GTAGCAAGAGGTGCTCATGCCTCTAGAATATGAGAC (SEQ ID NO: 412) |
| 3300014501\|Ga0182024_10150440_2 (SEQ ID NO: 232) | GTAGCAAAGGCAGCTTGACGCCTTAAAGATCAAGAC (SEQ ID NO: 413) |
| 3300001356\|JGI12269J14319_1000196 8_12 (SEQ ID NO: 233) | CTCGCAACGCCAGCGCAGGGGCCATGACGCTGCGAC (SEQ ID NO: 414) |
| 3300007533\|Ga0102944_1012316_2 (SEQ ID NO: 234) | GCATCAAAGGCAGTCCGATGCCTCTCAAATCGGAAC (SEQ ID NO: 415) |
| 3300005903\|Ga0075279_10000001_30 (SEQ ID NO: 235) | GTTGGAAAGGCTGCTCGAACGCCTTCAAGTCGAGAG (SEQ ID NO: 416) |
| 3300005524\|Ga0070737_10002282_10 (SEQ ID NO: 236) | CCGTGCGCAGCCGGATAACGCTGCGAC (SEQ ID NO: 417) |
| 3300005524\|Ga0070737_10031205_1 (SEQ ID NO: 237) | GTCGCGAAGCTAGCGCAGAAGCTTGGTATCTGCGAG (SEQ ID NO: 418) |
| 3300005524\|Ga0070737_10031205_1 (SEQ ID NO: 238) | GTCGCGAAGCTAGCGCAGAAGCTTGGTATCTGCGAG (SEQ ID NO: 418) |
| 3300005534\|Ga0070735_10023967_5 (SEQ ID NO: 239) | GCATCAAGTCTTATCTCGC (SEQ ID NO: 419) |
| 3300005542\|Ga0070732_10013271_3 (SEQ ID NO: 240) | GGCAGCGAAACGCCTTGAAG (SEQ ID NO: 420) |
| 3300010373\|Ga0134128_10000310_10 9 (SEQ ID NO: 241) | GTGTAATGCCCGGCAGAAGGCTTTGGATTCTGCGAC (SEQ ID NO: 421) |
| 3300010373\|Ga0134128_10011458_1 (SEQ ID NO: 242) | GTAGCAATGCCTACCAAGAGGCTTTGTATCTTGTGAG (SEQ ID NO: 422) |
| 3300010373\|Ga0134128_10096594_3 (SEQ ID NO: 243) | GGCGCAAGCCCTGCGCGGGAGGGCAAGATCCTGCGAC (SEQ ID NO: 423) |
| 3300010400\|Ga0134122_10000107_57 (SEQ ID NO: 244) | CAAGCCACGCTCGGGTGGC (SEQ ID NO: 424) |
| 3300010401\|Ga0134121_10002041_17 (SEQ ID NO: 245) | GGAGAGGGATCGTTTCTTCGACC (SEQ ID NO: 425) |
| 3300004633\|Ga0066395_10000027_32 (SEQ ID NO: 246) | CCGACAACGCCTGCGCAGGGGCGTGGTTTCTGCGAC (SEQ ID NO: 426) |
| 3300005332\|Ga0066388_100004304_4 (SEQ ID NO: 247) | GGTGCAACGTGCCTTGCGAGGGCTTGATACTCGCGAC (SEQ ID NO: 427) |
| 3300005332\|Ga0066388_100004304_2 (SEQ ID NO: 248) | GGTGCAACGTGCCTTGCGAGGGCTTGATACTCGCGAC (SEQ ID NO: 427) |
| 3300005764\|Ga0066903_100000051_2 7 (SEQ ID NO: 246) | CCGACAACGCCTGCGCAGGGGCGTGGTTTCTGCGAC (SEQ ID NO: 426) |
| 3300010047\|Ga0126382_10001209_14 (SEQ ID NO: 249) | GGTGCAACGTGCCTTGCGAGGGCTTGATACTCGCGAC (SEQ ID NO: 427) |
| 3300010047\|Ga0126382_10001209_12 (SEQ ID NO: 248) | GGTGCAACGTGCCTTGCGAGGGCTTGATACTCGCGAC (SEQ ID NO: 427) |
| 3300010048\|Ga0126373_10000093_10 2 (SEQ ID NO: 250) | GTGGTAATGGCAGCGCAGCGCCTTTGAGACTGCGAC (SEQ ID NO: 428) |
| 3300010366\|Ga0126379_10001683_10 (SEQ ID NO: 251) | GTTGCAGTACCCTGCTCACGGGGGAGACAAGTGAGAG (SEQ ID NO: 429) |

TABLE 3-continued

Nucleotide Sequences of Representative CLUST.018837 Direct Repeats

| Effector Accession | Direct Repeat Nucleotide Sequence |
|---|---|
| 3300010376\|Ga0126381_100020658_4 (SEQ ID NO: 252) | GGTGAAATGGCATCGGGAGGCCACAAACGTTCCGAC (SEQ ID NO: 430) |
| 3300010398\|Ga0126383_10032213_5 (SEQ ID NO: 253) | GTGATAGTGCCTGCTCAGTGGCTTAGT (SEQ ID NO: 431) |
| 3300017961\|Ga0187778_10004454_1 (SEQ ID NO: 254) | GTGACAAGAGCAGCGCGGCGCTCTGCGAGCCGCGAC (SEQ ID NO: 432) |
| 3300017970\|Ga0187783_10000008_23 (SEQ ID NO: 255) | CGAGTAGGCTTAGTTTGCTCGAC (SEQ ID NO: 433) |
| 3300017972\|Ga0187781_10019688_5 (SEQ ID NO: 256) | GGCGAAGCGTCAGCGCAGCCGTCTCGAGGCTGCGAC (SEQ ID NO: 434) |
| 3300018064\|Ga0187773_10011230_2 (SEQ ID NO: 257) | GTCGCGATGGCTGCTCGACGCCAGGAAGATCGAGAC (SEQ ID NO: 435) |
| 3300012204\|Ga0137374_10001132_4 (SEQ ID NO: 258) | GTCGAAATGCCCGCGCGGGGCGTCGTACCCGCGAC (SEQ ID NO: 436) |
| 3300012210\|Ga0137378_10000107_47 (SEQ ID NO: 259) | GCGTGTAGTAAGAGCAGCGGTGTCGCTCTGAGATGCCGAC (SEQ ID NO: 437) |
| 3300012532\|Ga0137373_10000316_4 (SEQ ID NO: 258) | GTCGAAATGCCCGCGCGGGGCGTCGTACCCGCGAC (SEQ ID NO: 436) |
| 3300012532\|Ga0137373_10000407_43 (SEQ ID NO: 260) | GCCCAAAGGCAGCTCGGCGCCTACAGAAGCCGAGAC (SEQ ID NO: 438) |
| 3300012930\|Ga0137407_10020190_4 (SEQ ID NO: 261) | GGTCGAAATGCCTGCGCAGGGGCTTCAACGCTGCGAC (SEQ ID NO: 439) |
| 3300005987\|1071089\|scaffold14955_2 (SEQ ID NO: 262) | ATCGAAGAGCCTGCGCAGAGGCTTTTGATCTGCGAT (SEQ ID NO: 440) |
| 3300005988\|1071091\|scaffold06014_8 (SEQ ID NO: 262) | ATCGAAGAGCCTGCGCAGAGGCTTTTGATCTGCGAT (SEQ ID NO: 440) |
| 3300006056\|1071094\|scaffold118627_2 (SEQ ID NO: 262) | ATCGAAGAGCCTGCGCAGAGGCTTTTGATCTGCGAT (SEQ ID NO: 440) |

REFERENCES

D. A. Benson et al., GenBank. Nucleic Acids Res. 41, D36-42 (2013).

K. D. Pruitt, T. Tatusova, G. R. Brown, D. R. Maglott, NCBI Reference Sequences (RefSeq): current status, new features and genome annotation policy. Nucleic Acids Res. 40, D130-135 (2012).

V. M. Markowitz et al., IMG: the Integrated Microbial Genomes database and comparative analysis system. Nucleic Acids Res. 40, D115-122 (2012).

Example 2—Functional Validation of Engineered CLUST.018837 CRISPR-Cas Systems (FIGS. 6-11)

Having identified the minimal components of CLUST.018837 CRISPR-Cas systems, we selected multiple example systems for functional validation, from the sources designated NZ_LDOS01000005 (SEQ ID NO: 1), 3300009004 (SEQ ID NO: 9), APMI01033782 (SEQ ID NO: 26), NZ_LVXZ01000012 (SEQ ID NO: 3), and ADIG01000806 (SEQ ID NO: 20).

DNA Synthesis and Effector Library Cloning

To test the activity of an exemplary CLUST.018837 CRISPR-Cas system, we designed and synthesized systems containing the pET28a(+) vector. The E. coli codon-optimized nucleic acid sequences encoding the selected CLUST.018837 effector proteins (amino acid sequence provided in TABLE 2) were synthesized (Genscript) and cloned into a custom expression system derived from the pET-28a (+) (EMD-Millipore) to create the Effector Plasmid. The engineered, non-naturally occurring vector included a nucleic acid encoding the CLUST.018837 effector protein under the control of a lac promoter and an E. coli ribosome binding sequence. The vector also included an acceptor site for a CRISPR array library driven by a J23119 promoter following the open reading frame for the CLUST.018837 effector protein (FIGS. 6A-D).

For the minimal CRISPR array, we designed oligonucleotide library synthesis (OLS) pools comprising two direct repeats flanking natural-length spacer sequences targeting the pACYC184 plasmid, select E. coli essential genes, and non-targeting negative control spacers for a total of 8900 elements in the array library. The spacer length was determined by the mode of the spacer lengths found in the endogenous CRISPR array. Flanking the minimal CRISPR array were unique PCR priming sites that enabled amplification of a specific library from a larger pool of oligo synthesis. These sequences were placed under the control of a J23119 promoter and cloned into the Effector Plasmid in both the forward and reverse orientations for a total library of ~18,000 plasmid elements We next cloned the minimal CRISPR array library into the Effector Plasmid using the Golden Gate assembly method. Briefly, we first amplified each minimal CRISPR array from the OLS pool (Agilent Genomics) using unique PCR primers, and pre-linearized the plasmid backbone using BsaI to reduce potential background. Both DNA fragments were purified with Ampure® XP (Beckman Coulter) prior to addition to Golden Gate Assembly Master Mix (New England Biolabs) and incubated per the manufacturer's instructions. We further purified and concentrated the Golden Gate reaction to enable maximum transformation efficiency in the subsequent steps of the bacterial screen.

The plasmid library containing the distinct minimal CRISPR array and CLUST.018837 effector sequence was electroporated into E. Cloni® electrocompetent *E. coli* (Lucigen) using a Gene Pulser Xcell® (BioRad) following the protocol recommended by Lucigen. The library was co-transformed with purified pACYC184 plasmid, plated onto agar containing chloramphenicol (Fisher), tetracycline (Alfa Aesar), and kanamycin (Alfa Aesar) in BioAssay® dishes (Thermo Fisher), and incubated for 10-12 hours at 37° C. After estimation of approximate colony count to ensure sufficient library representation on the bacterial plate, the bacteria were harvested and plasmid DNA extracted using a QIAprep Spin Miniprep® Kit (Qiagen) to create an "output library." By performing a PCR using custom primers containing barcodes and sites compatible with Illumina sequencing chemistry, we generated a barcoded next generation sequencing library from both the pre-transformation "input library" and the post-harvest "output library," which were then pooled and loaded onto a Nextseq 550 (Illumina) to evaluate the effectors. At least two independent biological replicates were performed for each screen to ensure consistency.

Bacterial Screen Sequencing Analysis

Next generation sequencing (NGS) data for screen input and output libraries were demultiplexed using Illumina bcl2fastq. Reads in resulting fastq files for each sample contained the CRISPR array elements for the screening plasmid library. The direct repeat sequence of the CRISPR array was used to determine the array orientation, and the spacer sequence was mapped to the source (pACYC184 or *E. coli* essential genes) or negative control sequence (GFP) to determine the corresponding target.

To identify specific parameters resulting in enzymatic activity and bacterial cell death, we used NGS to quantify and compare the representation of individual CRISPR arrays (i.e., repeat-spacer-repeat) in the PCR product of the input and output plasmid libraries. We defined the array depletion ratio as the normalized output read count divided by the normalized input read count. An array was considered to be "strongly depleted" if the depletion ratio was less than 0.33 (more than 3-fold depletion). When calculating the array depletion ratio across biological replicates, we took the maximum depletion ratio value for a given CRISPR array across all experiments (i.e., a strongly depleted array must be strongly depleted in all biological replicates). We generated a matrix including array depletion ratios and the following features for each spacer target: target strand, transcript targeting, ORI targeting, target sequence motifs, flanking sequence motifs, and target secondary structure. We investigated the degree to which different features in this matrix explained target depletion for CLUST.018837 systems, thereby yielding a broad survey of functional parameters within a single screen.

We generated a matrix including array depletion ratios and the following features for each spacer target: target strand, transcript targeting, ORI targeting, target sequence motifs, flanking sequence motifs, and target secondary structure. We investigated the degree to which different features in this matrix explained target depletion for CLUST.018837 systems, thereby yielding a broad survey of functional parameters within a single screen.

FIGS. 7A-E show the degree of depletion activity of the engineered compositions by plotting for a given target the normalized ratio of sequencing reads in the screen output versus the screen input.

To quantify depletion activity, an enrichment ratio was calculated as $R_{treated}/R_{input}$ for each direct repeat and spacer. The normalized input read count was computed as:

$$R_{input} = \text{\# reads containing } DR\text{+spacer/total reads}$$

where the reads counts were obtained from next-generation sequencing of the plasmid DNA library expressing a CLUST.018837 effector and associated crRNA prior to transformation. The normalized treated read count was computed as:

$$R_{treated} = (1+\text{\# reads containing } DR\text{+spacer})/\text{total reads}$$

where the read counts were obtained from next-generation sequencing of the plasmid DNA extracted from the surviving cells expressing CLUST.018837 effector and associated crRNA after antibiotic screening. A strongly depleted target had an enrichment less than 1/3, which was marked by the first vertical dashed line. Each CLUST.018837 effector was paired with a CRISPR array that took the form 5'-DR-[spacer]-DR-3' or 5'-reverse_complement(DR)-[spacer]-reverse_complement(DR)-3', and the depletion activity of both orientations of the DR are shown in the figure as indicated in the legend.

The results are plotted for each DR transcriptional orientation. In the functional screen for each composition, an active effector complexed with an active crRNA (expressed as a DR::spacer::DR) interferes with the ability of the pACYC184 to confer *E. coli* resistance to chloramphenicol and tetracycline, resulting in cell death and depletion of the spacer element within the pool. Comparing the results of deep sequencing the initial DNA library (screen input) versus the surviving transformed *E. coli* (screen output) suggest specific target sequences and DR transcriptional orientation that enable an active, programmable CRISPR-Cas system. The screen also indicates that the effector complex is only active with one orientation of the DR.

FIGS. 8A-E depicts the location of strongly depleted targets for CLUST.018837 systems targeting pACYC184, and FIGS. 9A-E depicts the location of strongly depleted targets for CLUST.018837 systems targeting *E. coli* essential genes. FIGS. 10A-E and FIGS. 11A-E depict strongly depleted targets for the negative control, whereby the nucleotide sequence encoding the CLUST.018837 effector has been deleted from the construct being screened. Notably, the presence of many strongly depleted targets in FIGS. 9A-E without corresponding activity in FIGS. 11A-E indicates interference activity that is dependent upon the expression of the CLUST.018837 effector and programmed by the RNA guide. Conversely, the appearance of strongly depleted spacers in the region of the pACYC184 origin of replication in both FIGS. 8A-E and FIGS. 10A-E (particularly prominent in the case of 3300009004) suggests that the observed depletion activity in the origin of replication is not related to the CLUST.018837 effector activity.

FIGS. 12A-E depict a weblogos of the sequences flanking targets strongly depleted by CLUST.018837 CRISPR-Cas systems, indicating a prominent 5' PAM of 5'-TTN-3' or 5'-YTN-3'.

RNA-Sequencing Mature crRNA from In Vivo Bacterial Screen

Sequencing the small RNA from the in vivo bacterial screen began by extracting total RNA from harvested screen bacteria using the Direct-zol RNA MiniPrep® Plus w/TRI Reagent (Zymo Research). Ribosomal RNA was removed using a Ribo-Zero® rRNA Removal Kit for Bacteria, followed by cleanup using a RNA Clean and Concentrator-5 kit. The resultant ribosomal RNA depleted total RNA was treated with T4 PNK, RNA 5' polyphosphatase, prepared for sequencing using the NEBNext® Small RNA Library Prep Set.

We analyzed the pre-crRNA processing in the screen output samples for the direct repeat orientation that demonstrated successful targeting of pACYC184 and *E. coli* essential genes. FIGS. 13A-C depict the alignment of extracted RNA against the input minimal CRISPR arrays, revealing the form of the mature crRNA. Mature crRNA sequences for example CLUST.018837 CRISPR-Cas systems are given in Table 4.

TABLE 4

Nucleotide Sequences of Mature crRNA of Representative CLUST.018837 CRISPR-Cas systems

| CLUST.018837 Effector Protein Accession | Mature crRNA Sequence |
| --- | --- |
| WP_081130164.1 (SEQ ID NO: 1) | TTTCATCGGCCATCGCGG CGGCCTCGTAGCTGCGAC NNNNNNNNNNNNNNNNN (SEQ ID NO: 1001) |
| WP_081130164.1 (SEQ ID NO: 1) | TTCATCGGCCATCGCGGC GGCCTCGTAGCTGCGACN NNNNNNNNNNNNNNNNN (SEQ ID NO: 1002) |
| 3300009004\|Ga0100377_1000348_44 (SEQ ID NO: 9) | ACAACAGCCATTACCCT GGCTTAGTAAGGGTGACN NNNNNNNNNNNNNNNNN (SEQ ID NO: 1003) |
| ADIG01000806_20 (SEQ ID NO: 20) | TTCCAAGGCGATCACAGC CGCCTAGTAGTTGTGACN NNNNNNNNNNNNNNNNN (SEQ ID NO: 1004) |

In Vitro Pre-crRNA Processing

In an effort to reconstitute processing of the NZ_L-DOS0100005 pre-crRNA into a mature crRNA in vitro, we synthesized a pre-crRNA oligonucleotide template containing a T7 promoter followed the sequence, direct repeat (DR)-spacer1-DR-spacer2-DR. We PCR amplified the purified oligonucleotide template to select for full-length products and expressed the pre-crRNA using T7 in vitro transcription. The in vitro transcribed pre-crRNA was incubated with 0.0675 uM-1 µM of purified NZ_LDOS0100005 in 1×NEB Buffer2 with or without magnesium for 30 min. at 37° C. The resulting product was treated with proteinase K, supplemented with EDTA, denatured at 65° C. for 3 min., and run out on a 15% TBE-urea PAGE gel for analysis by SYBR-gold staining. FIG. 14 shows pre-crRNA treated with effector protein is processed into a mature crRNA in a dose-dependent manner without a dependence on magnesium.

Example 3—Adaptation of CLUST.018837 CRISPR-Cas System Effectors for Eukaryotic and Mammalian Activity DNA-modifying CRISPR-Cas systems such as CLUST.018837, systems described herein have important applications in eukaryotic cells such as therapeutic modification of the genome, with example modifications including but not limited to; genotype correction, gene knockout, genetic sequence insertion/deletion (by homology directed repair or otherwise), single nucleotide modification, or gene regulation. These gene modification modalities can utilize either natural or engineered activities of the CLUST.018837 CRISPR-Cas systems.

Without wishing to be limited, the applications in eukaryotic cells for the CLUST.018837 CRISPR-Cas system can be divided up into those utilizing nuclease and non-nuclease (also known as nuclease-dead) functionalities. For nucleases, in some embodiments, the natural nuclease activity of the CLUST.018837 CRISPR effector may be sufficient for applications such as gene modification, while in other embodiments, the targeted nuclease activity can be augmented by the fusion of additional nuclease domains (such as FokI) to either a nuclease-weak or nuclease-inactivated CLUST.018837 CRISPR effector. For non-nuclease functionalities, such nuclease-weak or nuclease inactivated CLUST.018837 CRISPR effectors can either be used directly or be fused to other functional domains. Both nuclease and non-nuclease functionalities are subsequently described in greater detail.

To develop CLUST.018837 CRISPR Cas systems for eukaryotic applications, the constructs encoding the protein effectors and/or their fusions are first codon-optimized for expression in mammalian cells, and specific localization tags are optionally appended to either or both the N-terminus or C-terminus of the effector protein. These localization tags can include sequences such as nuclear localization signal (NLS) sequences, which localize the effector to the nucleus for modification of genomic DNA. Other accessory proteins, such as fluorescent proteins, may be further appended. It has been demonstrated that the addition of robust, "superfolding" proteins such as superfolding green fluorescent protein (GFP) can increase the activity of CRISPR enzymes in mammalian cells when appended to the effector (Abudayyeh et al. (2017) *Nature* 550(7675): 280-4, and Cox et al. (2017) *Science* 358(6366): 1019-27).

The codon-optimized sequence coding for the CLUST.018837 effector and appended accessory proteins, fusion proteins, and/or localization signals is then cloned into a eukaryotic expression vector with the appropriate 5' Kozak eukaryotic translation initiation sequence, eukaryotic promoters, and polyadenylation signals. In mammalian expression vectors, these promoters can include, e.g., general promoters such as CMV, EF1a, EFS, CAG, SV40, and cell-type specific RNA polymerase II promoters such as Syn and CamKIIa for neuronal expression, and thyroxine binding globulin (TBG) for hepatocyte expression to name a few. Similarly, useful polyadenylation signals include, but are not limited to, SV40, hGH, and BGH. For expression of the pre-crRNA or mature crRNA, RNA polymerase III promoters such as H1 or U6 can be used.

Delivery of the complete effector and RNA guide to the eukaryotic cells or tissues of choice can come in many different forms. For delivery to cells, in some embodiments. Transfection or nucleofection can deliver DNA or RNA from which the protein and/or RNA guide(s) is/are synthesized and assembled by the cellular machinery into active protein complexes, or the ribonucleoproteins (RNPs) themselves can be pre-formed extracellularly and delivered as a complete complex. Other applications may require the use of viral delivery, in which case the eukaryotic expression vector can be a lentiviral plasmid backbone, adeno-associated viral (AAV) plasmid backbone, or similar plasmid backbone capable of use in recombinant viral vector production. In particular, the small size of the CLUST.018837 CRISPR effectors make them ideally make them ideally suited for packaging, even when fused with other functional domains, along with its crRNA and appropriate control sequences into a single adeno-associated virus particle; the packaging size limit of 4.7 kb for AAV may preclude the use of larger effectors, particularly if large cell-type specific promoters are used for expression control.

After adapting the sequences, delivery vectors, and methods for eukaryotic and mammalian use, the different constructs as described herein are characterized for performance. For nuclease-based applications, in some instances, for testing of the mammalian nuclease activity of various constructs, we use a genomic dsDNA cleavage assay using either NGS or Surveyor nuclease readout to quantify the efficiency of indel formation (Hsu et al. (2013). In addition to testing various construct configurations and accessory sequences on individual targets, pooled library-based approaches are used to determine 1) any targeting dependency of specific constructs in mammalian cells as well as 2) the effect of mismatch locations and combinations along the length of the targeting crRNA. Briefly, the pooled library includes a selection plasmid that expresses a target DNA containing different flanking sequences as well as mismatches to the guide or guides used in the screening experiment, such that the successful target recognition and cleavage results in depletion of the sequence from the library. Furthermore, targeted indel sequencing or unbiased genome-wide cleavage assays can be used to evaluate the specificity of the CLUST.018837 nuclease constructs (Hsu et al. (2013), Tsai et al. (2015), Kim et al. (2015), Tsai et al. (2017)).

In addition to nuclease-based genome editing using CLUST.018837 effectors and a crRNA, additional template DNA sequences can be co-delivered either in a vector, such as an AAV viral vector, or as linear single stranded or double stranded DNA fragments. For insertion of template DNA by homology directed repair (HDR), template sequences are designed containing a payload sequence to be inserted into the locus of interest as well as flanking sequences that are homologous to endogenous sequences flanking the desired insertion site. In some instances, for insertion of short DNA payloads less than (for example: less than 1 kb in length), flanking homologous sequences can be short (for example: ranging from 15 to 200 nt in length). In other instances, for the insertion of long DNA payloads (for example: 1 kb or greater in length), long homologous flanking sequences are required to facilitate efficient HDR (for example: greater than 200 nt in length). Cleavage of target genomic loci for HDR between sequences homologous to template DNA flanking regions can significantly increase the frequency of HDR. CLUST.018837 effector cleavage events facilitating HDR include, but are not limited to dsDNA cleavage, double nicking, and single strand nicking activity.

Applications can also be based on non-nuclease functionalities of the CLUST.018837 effector and constructs from the fusion of the effector with a functional domain. In this context, the CLUST.018837 effector refers to both the natural effector amino acid sequence as well as any functional modifications to reduce or eliminate its nuclease activity. CLUST.018837 effectors have programmable DNA binding activity, which can be directly used in applications such as DNA immunoprecipitation, or other domains can be appended onto the effector to provide further functionality. Activities of these domains include, but are not limited to, DNA base modification (ex: ecTAD and its evolved forms, APOBEC), DNA methylation ($m^6A$ methyltransferases and demethylases), localization factors (KDEL retention sequence (SEQ ID NO: 1015), mitochondrial targeting signal), transcription modification factors (ex: KRAB, VP64). Additionally, domains can be appended to provide additional control, such as light-gated control (cryptochromes) and chemically inducible components (FKBP-FRB chemically inducible dimerization).

Optimizing the activity of such fusion proteins requires a systematic way of comparing linkers that connect the CLUST.018837 effector with the appended domain. These linkers may include, but are not limited to, flexible glycine-serine (GS ("GS" disclosed as SEQ ID NO: 1005)) linkers in various combinations and lengths, rigid linkers such as the alpha-helix forming EAAAK sequence (SEQ ID NO: 1016), XTEN linker (Schellenberger V, et al. *Nat. Biotechnol.* 2009; 27:1186-1190), as well as different combinations thereof (see TABLE 5). The various designs are then assayed in parallel over the same crRNA target complex and functional readout to determine which one yields the desired properties.

For adapting CLUST.018837 effectors for use in targeted DNA base modification (see, e.g., Gaudelli et al. (2017) "Programmable base editing of A·T to G·C in genomic DNA without DNA cleavage" Science 25 Oct. 2017), one begins with a panel of CLUST.018837 effectors that yielded strong interference activity in in vivo *E. coli* bacterial screens. These effectors, whether with nuclease-inactivating mutations or in their natural forms, are mammalian codon optimized and tested for specific and programmable dsDNA binding in an in vitro environment such as using an electrophoretic mobility shift assay (EMSA).

Next, a linker is used to create the fusion protein between CLUST.018837 effector and the base editing domain. Initially, this domain consists of the ecTadA(wt)/ecTadA* (7.10) heterodimer (hereafter referred to as the dCas12i-TadA heterodimer) engineered previously for hyperactivity and modification of dsDNA A·T dinucleotides to G·C (TABLE 7). Given the structural differences between the smaller CLUST.018837 effectors versus the previously characterized Cas9 effectors, alternate linker designs and lengths may yield the optimal design of the base editing fusion protein. Further optimization of the location of the nuclear localization sequence may also be required.

To evaluate the activity of the CLUST.018837-derived base editors, the HEK 293T cells are transiently transfected with the CLUST.018837 effector-TadA heterodimer construct, a plasmid expressing the crRNA, and optionally, a reporter plasmid if targeting the reporter and not an endogenous locus. The cells are harvested 48 hours after transient transfection, and the DNA is extracted and prepared for next generation sequencing. Analysis of the base composition of loci of samples containing the targeting vs. negative control non-targeting crRNAs provide information about the editing efficiency, and analysis of the sequences at computationally predicted sites of close sequence similarity yields information about the off-target activity.

One particular advantage of developing a DNA base editing system using CLUST.018837 effectors is that the small size, smaller than the existing Cas9 and Cas12a effectors, enables more ready packaging in AAV of CLUST.018837 effector-TadA heterodimer along with its crRNA and control elements without the need for protein truncations. This all-in-one AAV vector enables greater efficacy of in vivo base editing in tissues, which is particularly relevant as a path towards therapeutic applications of CLUST.018837 effectors.

TABLE 5

Amino Acid Sequences of Motifs and Functional Domains in Engineered Variants of CLUST.018837 CRISPR-Cas Effector Proteins >LINKER_1
GS
(SEQ ID NO: 1005)
>LINKER_2
GSGGGGS
(SEQ ID NO: 1006)
>LINKER_3
GGGGSGGGGSGGGGS
(SEQ ID NO: 1007)
>LINKER_4
GGSGGSGGSGGSGGSGGS
(SEQ ID NO: 1008)
>LINKER_5 (Gaudelli et al., 2017)
SGGSSGGSSGSETPGTSESATPESSGGSSGGS
(SEQ ID NO: 1009)
>ecTadA (wt) (Gaudelli et al., 2017) [N-term fusion to ecTacIA*(7.10)]
MSEVEFSHEYWMRHALTLAKRAWDEREVPVGAVLVHNNRVIGEGWNRPIGRHDPT
AHAEIMALRQGGLVMQNYRLIDATLYVTLEPCVMCAGAMIHSRIGRVVFGARDAKT
GAAGSLMDVLHHPGMNHRVEITEGILADECAALLSDFFRMRRQEIKAQK KAQSSTD
(SEQ ID NO: 1010)
>ecTadA*(7.10) (Gaudelli et al., 2017) [N-term fusion to CRISPR nuclease]
MSEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMRRQEIKAQKKAQSSTD
(SEQ ID NO: 1011)
[Cytidine deaminase, AID, APOBEC1: N-term fusion (or optionally C-term)]
>AID-APOBEC1 (Dickerson et al., 2003, Komor et al., 2017)
MDSLLMNRRKFLYQFKNVRWAKGRRETYLCYVVKRRDSATSFSLDFGYLRN
KNGCHVELLFLRYISDWDLDPGRCYRVIWFTSWSPCYDCARHVADFLRGNP
NLSLRIFTARLYFCEDRKAEPEGLRRLHRAGVQIAIMIFKDYFYCWNIFVE
NHERTFKAWEGLHENSVRLSRQLRRILLPLYEVDDLRDAFRTLGL
(SEQ ID NO: 1012)
>Lamprey AID-APOBEC1 (Rogozin et al., 2007, Komor et al., 2017)
MIDAEYVRIHEKLDIYIFKKQFFNNKKSVSHRCYVLFELKRRGERRACFWG
YAVNKPQSGTERGIHAEIFSIRKVEEYLRDNPGQFTINWYSSWSPCADCAE
KILEWYNQELRGNGHTLKIWACKLYYEKNARNQIGLWNLRDNGVGLNVMVS
EHYQCCRKIFIQSSHNQLNENRWLEKTLKRAEKRRSELSIMIQVKILHTTKSPAV
(SEQ ID NO: 1013)
>APOBEC1_BE1 (Komor et al., 2016)
MSSETGPVAVDPILRRRIEPHEFEVFFDPRELRKETCLLYEINWGGRHSIWRHISQNIN
KHVEVNFIEKFTTERYFCPNIRCSITWFLSWSPCGECSRAITEFLSRYPHVILFIYIARL
YHHADPRNRQGLRDLISSGVTIQIMTEQESGYCWRNFVNYSPSNEAHWPRYPHLWV
RLYVLELYCIILGLPPCLNILRRKQPQLIFFTIALQSCHYQRLPPHILWATGLK
(SEQ ID NO: 1014)

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1056 sequences)

SEQ ID NO: 1 - protein, 627 aa, Metallibacterium scheffleri
MKLSPALPPTGDVLIYEYGARVDGDCLPAVGDQIAKARRLYNDLVAVIRGIVDEMRGFVLKHAGSEALALQARIDGLSEAFDAARAANDEDRMKQIAGERRALWAELGEQVKAVRKAHRAEIQELFLSRIGKKSTCDTYQMRCKAVGDGLGWATANQVLDAALQAFKTSFQRGQAPRFARGEEKIQDTLTLQFTAAGGVPVAALLSGDHSELSMVSSCGRRKYGSFSFRLGSASADTYANGTWQYHRPLPDGATVGLARLVRRSVGKDFKWALQLMVKRPATEPAMMEGRKPLVAVHFGWAGDASGRRVAGITDGADPGVARVLQLPVEVEDGIRRAAEFQSARDEARDVIMTTIKNIAWGDAVACLGESSQFMHGSEPWLRARLSEELSTIRRLPAQHVAPRRLHRLCGLLRATNQMHDELEAWRKQDRLAWQASAHMARRARNLRKDFYRRVAIDLARRYSAIVLEPLDLAAAALKVNEITGEKTEFAKKARSGRVVAAIYELESSIRWAAAKSGTALLDLSGAETAARCGICGGASQSDESNSQVLHCVECGAELDRKKNGAAIAWQFAHENLDEAVTDFWAAVIAQRCEHAEKTREKKAKMAEGRRLARTLSAGVSAVGSRNV

SEQ ID NO: 2 - protein, 633 aa, Thiobacillus denitrificans
MSEIKPSLLPQGNVLIYEYGARLDKDCIQAVGDQIIKSRRLYNDLVATIRGIVTEMKAFVLEKSGPDAQRCQEEIDALNAAFDAARAENNEDAMKCIAESRREKWRELAVFVKEARKNHRSDIQSMYLSRIGKNSACETYRIRSKAVADGLGWATANQVLDAALTAFKKSFARGNAPRFAVGEDKDQDTLTLQFTAAGGVPVDTILAGKHGEVALSPTNGCGPRKYGELRFRLGAAKAATNATGTWQYHRPLPDGATAGLCRLIRRRVGKDYKWAIQMQVKRPPIEQEALAGRKPLVAVHFGWAANDEGRCVAGITDGADPGQAYVLKLPAEVEQSLVRSSAIQSERDSARDAIVPRLKEIEVPDMDIESVESLPPDSPEVRLARAADELKAIHRLPANHVAIRRLHRLCGMLRDVDFLPEWLEDWRKEDRLQWQSAAHIARRARNTRKGFYRQTAIDLARQYSSIVLEPLDLAKAAVKIDEITGERTEFAKKARAGRVVAALYELESAIRWAAAKAGSAMFELTGETASRCSICGGDVLPDETNGQLLHCTECGADLDRKQNGAAMAWQLANDDLESLVEAFWTETFAARRSAENEQAEKKQKMAEGRRKARTPIGGENTEVSRDSGNGANA

SEQ ID NO: 3 - protein, 596 aa, Acidithiobacillus ferrooxidans
MSTITYEYGVRLEPDCIQHVDHQIILARGTYNEMIAAMRSVHDAAQSFQMEKAGPEGRAIAARIEALNTAFKEARAQQQEESLLQAIAVERRQCWRDLGVILKGVRQEHKKTLQEVFYNRIGINKGTDTYAIRCKAVADGLGWATAQDVLNRAIIAWKMSMKLGRAPQFARGDEKTQDALTVQFTEKGGMPKDKMLEGESAVIGVEQPENTGKRAYGHFWFRLGSASEGHYARGTIQWHRDLPEDASMASARLVRKRTGCKMKYYMQYVINTAQIRQVSDHARKALLAVHMGWSADISGRRVCGITDAADPELAQIIQLPPEIERNIQRAANIQGKRDQARDEIAPKIRAFDGSLPPEWDESTQDYWSHWKVLPANHMAASRIHAWRKRLGDFAPEWMAEWCKADRMLWIAATHTAQRARNRRKDFYRNLAKTWASQYEAIVIEKPDIKKAAKILDEATGERTEFAKKARAGRVLASLYTLDSAIRWACQKNGTAILDMNGEKTAATCAMCASEAIRADTEDGQVLHCADCGAVLDRKKNGAAVAWQLVNEQRENLVEEYWAEQLNKEREAAEAKASRLEKMQAARRAKREPALAD

SEQ ID NO: 4 - protein, 593 aa, Acidithiobacillus thiooxidans
MNLKVCGDIDDQIRRARAMYNNIIAVMRGIYDEMQTFTMEHAGPEGQALHEKIVAANVAFDAAKADNDEPRMKQIAMERRELWKALSIILKEVRKEHKNTLKERFYSRIGNNSSTETYQCRAEAIVGGLGYATATKVLDNALKAWQMSMVKGKAPRFARGEEKDQDTLTLQFSQAGGVPVEDIFTGKRKDIGIEYPKKGFGPRSYSAFRFRLGAASEESYAEGTVQLHRAIPENARIAMAHLTRKKAGRKYQYELQLLATLAEPINLLPDHRRKPLVAIHFGWSGDEEGRRLAGIADNADPLEARLLTLPPDIEDDIREASALQAKRDTYRDEVFLRLKEENTLPTKGETPLSEHWNKIRKLPAQHVSANRMHHLAWLVKSELIEIPEWFETWRKADQRMWVQATSLARRARNRRKKYYEKVAIDLASRYEAILIEMPDLKKSAEKVNEKTGEKTEFAKKARSGRVIAALYVLESAIQWAACKHGSAVLKIKGEKTASVCAFCEGDHLEEKEEHDSQTLYCPDCGSTVDRKLNGAANAWKRAASDLESLVTEYWEETREKQMGKAETKRLKSEKMAEARRLKRQAASQASAGA

SEQ ID NO: 5 - protein, 615 aa, Acidithiobacillus thiooxidans
MSQIKIVPQINGSQLVYKYGVRMNLKVCGDIDDQIRRARAMYNNIIAVMRGIYDEMQTFTMEHAGPEGQALHEKIVAANVAFDAAKADNDEPRMKQIAMERRELWKALSIILKEVRKEHKNTLKERFYSRIGNNSSTETYQCRAEAIVGGLGYATATKVLDNALKAWQMSMVKGKAPRFARGEEKDQDTLTLQFSQAGGVPVEDIFTGKRKDIGIEYPKKGFGPRSYSAFRFRLGAASEESYAEGTVQLHRAIPENARIAMAHLTRKKAGRKYQYELQLLATLAEPINLLPDHRRKPLVAIHFGWSGDEEGRRLAGIADNADPLEARLLTLPPDIEDDIREASALQAKRDTYRDEVFLRLKEENTLPTKGETPLSEHWNKIRKLPAQHVSANRMHHLAWLVKSELIEIPEWFETWRKADQRMWVQATSLARRARNRRKKYYEKVAIDLASRYEAILIEMPDLKKSAEKVNEKTGEKTEFAKKARSGRVIAALYVLESAIQWAACKHGSAVLKIKGEKTASVCAFCEGDHLEEKEEHDSQTLYCPDCGSTVDRKLNGAANAWKRAASDLESLVTEYWEETREKQMGKAETKRLKSEKMAEARRLKRQAASQASAGA

SEQ ID NO: 6 - protein, 617 aa, Rhodanobacter sp.
MKITPASLPQGDVRIYEFGARLDKDCLEAANDQFFKAHQLYNELVACMQGTLRDMQAYLLENAGQEAQSAQARVEALNEALSAAKAANDEDTMKAVASERREVWRTLAALLRDTRKVHKATLQERFLCRIGRKSTCATYQLRCDAVAAGLGWATANATLDAALLAFKSSFVQGRAPRFAKAGESTQDSLTLQFTAAGGVSVSTLLEGRHTEFRVKASGGCGPRRYGTLEFRLGPASSETYAAGTWQYHRAMPDDGAVGLVRLVRRRLGPKFQWAIQFQVRSPLPVNDSVGERKPLVALHAGWAADLTGRRVAGIADGADPGLARVLQLPPEIEAGLQHSGEVESARSVARDNVVATLKAHAWPQDLLDAAEQPTEDATPEATRRSQAAADLLVIRRLPATHVAIRRLHRLAQRLRDTADLPDWFEAWRKEDKLAWQKAAHAAKRARNRRKGFYREVALGLATGYQAIVLQPLDLESAAKKVDDASGERTEFGRKARSGRVVAAIYELEGAIRWAAAKCGTAVLELTGETAGHCAYCGGAVKPVEDDSQRLACTQCGADIDRKRNGAALAWQATEESLPTLVEDFWRETLAARDGAAAKRKEKREKVAEARRASRVVE

SEQ ID NO: 7 - protein, 655 aa, Unknown
  source: /note="Description of Unknown: activated carbon metagenome sequence"
MTMEQAMVGAVYESASAAGEEVMASRNETTQEETDAFSVSFSTVGPAEVMVYEFGCRIAKGDLDHLRDQLWRSRRLFNEVAAQINQTVDEAKCFLSDRAGPVAGEIAVRLGVLDTEWKSAKALDDREALVKIAGERKSLRTRWYGLLHKARREHGTELRERYLSRIGNRVGAATYALRCAAVDDGLDWAMGNEALAAALGAFGKQWPRFKPISFRRFDDPTEVATLQFTAAGGVAVADILADKHSQIGMQLGREQAGRRMYVPFRMKLGSGAQKKAITGTVLYHRPLPAGASVPIARLVGRRIGKDVKHYLQFMVKLKQAEQPGANSKRAPMGVAHLGWYYQPTGRRLAEVASSEDPGLSEQLTLPIEVAELLDRARELDGQRSKLRDGIVGSVVRELPVEGAPEQIAEEVAALRKMRIEHVAPRRLGKLVFIWSRNCADWQRDRLKAMQAWRLEDRMLWQSSAHTARRARNRRRKHYEQLALSLAGKFTNILIDVPDLAQVAKVKDEDTGEHNGLGARARGGRFDAALYELTSAIEKAGARLGCNVGKIKGPTASTCAHCGGTTKMGKTVRDVVCEACGAVEDRAASAAAVAFGWASQNKDAVDEAVAAALDADRAKATRAAERKEKMAIARATSRAARTESDEDSADGSRELK

SEQ ID NO: 8 - protein, 573 aa, Unknown
  source: /note="Description of Unknown: aquatic-freshwater sequence"
MTIKVYKFGLLDPVSGWDQTAIDVLFLRNKLWNNLVAMEHDKRQAYRNLLLDSDTELAALQARLDAIEVEKASLITSKKALRAKARSRQVDTAEIDLEIKKLLEERKALGGQTKDLRERVKIEVKPLAAELDQQRYEKTKQLNKESGLWWCNSMTVIAAYEVGRLRAMREKNELRFHGFDGTGKYSVCRTGGFSLDHVMTGKLSFVSIRTLPIANLDDLSERGQRSRARHHLTMIVLRATTEEGTKIRHEVTWPIILHRPLPDDCLIKQIQVLRKRVGDRFEWTCSITVDTPEELKARLDSPSISVCGIDLGFRQVNNDLRVATLADSSGGLRYYTIGKDWLDSMDYVEAIQSDLSGTANSVWAQLRLILKELDEYPEALRERITDMLKAGAKTPIRAMRAMQKTLSNEPDLMPDALALLDDWKKRIRRRTKEMHDLRDKLINRRKDIYRNIACEIARDYSLVRIANLKLKDMVKLKRNDGTDTKLTDNARKNCNRAALSELTLYIQQACAKNGVALEKIDTTYMTRTCYQCGYLNPANTINLLLSCEGCGAEYDQDDNAAKNYLNATKPGTG

SEQ ID NO: 9 - protein, 614 aa, Unknown
  source: /note="Description of Unknown: aquatic-freshwater-aquifer sequence"
MTNQENFSIKAAKTPSGDVLIYEFGARLDKECAAEVDKQIKQARGLYNNIVALMRDTMDEMRADLVENAGPVARETQAAIDALNLKFAEAKARDDEGAMLLIAQQRRELWAQLSALLKEVRASLKSEHKSRFFSRIGINSSCATYQLRSVAVKEGLGWGTANEILDNVLGAWKKSLAMGKAPRFVSAAEKMQDTLTLQFTAAGGISVVDLLSRSKGDMILTPPSEAGKRKYGSFQFRMGAASSNSYATGTWQYHRPLPEGSSVGVARLIRRRVGKDTKYAIQLQVKIKEGIEQAVRNRKPLATVHFGWAGDVEGRRVAGIADSAEPSSAQVIALPTEIEEMLARSTTIQGERDTERDNIVPVVKQLDPTKFDETLAEEVTALNKLPAQHIAIRRLHRLCRHLGDVDMLPEALAEWRKADRMRWQSETHLARRARNQRKDFYRNIAINLARNYEVIAIEPLDLAKAAIKLDKMTGEKTELSKKARSGRVVAAIYELESAIRWAAVKTGAAVLELTAAKTASVCSICGGHVSDDTENSQILHCDDCGADLDRKQNGAAIAWQMVEPLREDLAVDYHQAKIDAARATKQKMVEKLGKLAEGRLKGREAKAGSAANPE

SEQ ID NO: 10 - protein, 582 aa, Unknown
  source: /note="Description of Unknown: aquatic-freshwater-freshwater sediment sequence"
MINCYKFGCLQPTAGFDQSAIEHLFLRNKLWNTLVALDHEFRQRYRDLMLNSDEKLKSVQDSIDSINQEIEDLVENKMKLRQKERTKNIDSKLLDERINVLKAKRKTLSADSKTERERVKVEIKPQIDLLNTERYEAKKLAYKESGLWWGNYETVVAAYDTASQKAMKSNTELRFKSFDGSGKFAVRFEDGGLTIDELKAGASNLCRIETLNTSAFQNLSQRSIKSKARHSLTMTIYTFNDEKGKKQRKEITVPIIFHREMEEGKIKTIHLQRKRLGNQFTWSASFTLKNDIEPANVADHPATASCGIDLGYRLVKDGLRVATVADSQNNVEYLVLPKSWIDRMDYTETLQSGLSEAMTLMWAKLKAEIAKIPEYPDAVAEIIKNMQKMGDRLPYKGIKRLYRVLKEQDATGSPVAGFNAVLDILKAWDKATYRQELEMVNLKDKLLKQREHIYRNFAAGLTKKYAHIVVEDMGLAELAKTEKSETETNDMPNAVKANRQRASLYSLVEAIRLSAAKVGSYFEKSKAAYSSMTCNVCGHLNPKTQNIHQSCESCNTMYDVDENAARNFLKGEYINEKVLKQG

SEQ ID NO: 11 - protein, 585 aa, Unknown
  source: /note="Description of Unknown: aquatic-marine sequence"
MATRVYKYGLIPIGYPPQAAIDELFRANSLKNTLVALHRESRENWDDARRSASILYSEKMDELDKKNEDITEAFNGLNKARMDEGTKDETGNKRLLAERAIINRLKKEKGDIYAELKPLRKEADKSIDKKALNDAYRQKCNDAVSAKVSGVYRRTAEQIYANFKTAKDKASKDNATLQFHRFDGTGYFQFRCNPKGVSTDGISVDAFMSANFDGYMRCAVQSVDNSKKKPRIRINAVLAGGRTKASKVFQEFDWIYHRPLPADAQIQNGKILRTRVGDKFRYDLVLTIRVPDVEMVQPAKLSGTIGIDVGFRKVGNTLLIGTVMSSDRSQKAVALEVPQMMVSALEHVVALQGELDDAASDLGKAITPLLKANPIDDEHSKYRLWRSLALRPLHVTLSFEQAYKLSLWLKHEPSLFPSEINLKVHTWWRSYSRKYREIHNRRKKQLTHRKHFYRETAAKLVAENKLIVLEDINLTDFAETKSKNTKLSNKARAQRFMASLGEFRDAIKNAAGREGVPVIDVNPAYTSKTCSDCGHLNKELRSEKEWTCPACGVVHDRDENAANNLQKMGQKYLLDVQKAASMVVQ

SEQ ID NO: 12 - protein, 587 aa, Unknown
  source: /note="Description of Unknown: aquatic-marine sequence"
MTTRVYKYGLIPIGYPPQVAIDELFRANNLWNTLVALHRESRENWDDARRSASILYSEKMDELDKKNKDIREAFNGLNQARMDEGTKDETGNKRLQAERAIINRLTKEQKEIYAELNPLRKEADKTVDKKALNDEYRKKCNTAVSAKVSGVYSRTAGELYAYFRTARDKAFKDKTTLRFHRFDGTGYFAFRCRSKAVGVNVDGISVEDFMSQGFMDYMRCAVMSIDESKKKPRILISAVLTGGATKASKVVQEFDWIYHRPLPPEGQIQNGKILRTRVGDKFKYDLVLTVKLPDVEMIQPAALNGTIGIDVGFRKVGNSLLIGTVMFSDSAQKAVALEVPTMVVSALEHVDALRSELDDVASDLGKAITPLLKANPIDEEHDKYRLWRSLALRPLHVTLSFEQAYKLALWLKREPNLFPSEINEKVHTWWRSYSRKYREIHNRRKKQLTHRKHFYRETAAKLIAQNKLIVLEKIDLTDFAETKNKNTKLSNKARSQRFMAALGEFRDAIKNAADREGVPVIDVNAAYTSKTCSECGYLNKELKSEKEWNCPECGVVHDRDENAANNLQKMGQKYLLDAAKTAVVVVK

SEQ ID NO: 13 - protein, 569 aa, Unknown
  source: /note="Description of Unknown: aquatic-marine sequence"
MAIDELFRANNLWNTLVALHRESRENWDDARRSASILYSEKMDELDKKNKDIREAFNGLNQARMDEGTKDETGNKRLQAERAIINRLTKEQKEIYAELNPLRKEADKTVDKKALNDEYRKKCNTAVSAKVSGVYSRTAGELYAYFRTARDKAFKDKTTLRFHRFDGTGYFAFRCRSKAVGVNVDGISVEDFMSQGFMDYMRCAVMSIDESKKKPRILISAVLTGGATKASKVVQEFDWIYHRPLPPEGQIQNGKILRTRVGDKFKYDLVLTVKLPDVEMIQPAALNGTIGIDVGFRKVGNSLLIGTVMFSDSAQKAVALEVPTMVVSALEHVDALRSELDDVASDLGKAITPLLKANPIDEEHDKYRLWRSLALRPLHVTLSFEQAYKLALWLKREPNLFPSEINEKVHTWWRSYSRKYREIHNRRKKQLTHRKHFYRETAAKLIAQNKLIVLEKIDLTDFAETKNKNTKLSNKARSQRFMAALGEFRDAIKNAADREGVPVIDVNAAYTSKTCSECGYLNKELKSEKEWNCPECGVVHDRDENAANNLQKMGQKYLLDAAKTAVVVVK

SEQ ID NO: 14 - protein, 585 aa, Unknown
  source: /note="Description of Unknown: aquatic-marine-pelagic marine sequence"
MATRVYKYGLIPIGYPPKETIDELFKANVLWNNLVALHRKNREDWDDARRAASILYSDKIDELEKKEEDLDAAWKAFQQARMDEGTRDETNNKRLKSERASINRLKAERAEIYKELKPLRKEADKEIDKKQLNDSFRAQVNEALSVNNSGVYRAIADQIYENFKTAKDKSIKENATLRFHRFDGTGYYHFRCRRKGTNVDGISIDDFMSRNFEAYPRCAVQNIDNSKKKPRIRINAVLAGGKSKASKIHQEFDLIYHRPLPIDAQIQNGKILRTRVGDKFKYDLVLTLKIPDKEPISYNNLKGTIGIDIGFRRSVNSLLIGTVMSSDVTEEAYEIIVPPKIVEAFEHVIDLQSELDDAATDLGRIITPLLKAHPLDEDHSKYKMWRSLALRPAHVTLSFEQAYKLAIWLKHEPDTFPEEITKKVHTWWRSYSRKYRELHNRRRNQLTHRKHFYREEAAKIVALNKLIVLEEINLTDFAETKEKNTKLSKKARAQRFMASLSEFRDAIKNAAQRDGIGIIDVNPAYTSKTCSECGNLNKDLRSEKQWSCPACGVVHDRDENAANNLQKMGQSYLENIKKETSEIIE

SEQ ID NO: 15 - protein, 585 aa, Unknown
  source: /note="Description of Unknown: aquatic-marine-pelagic marine sequence"
MATRVYKYGLIPIGYPPKETIDELFKANVLWNNLVALHRKNREDWDDARRAASILYSDKIDELEKKEEDLDAAWKAFQQARMDEGTRDETNNKRLKSERASINRLKAERAEIYKELKPLRKEADKEIDKKQLNDSYRAQVNEAISVRNSGIYNATAGQVLDNFKAARDRSFKENATLKFHRFDGTGYYHFRCRRRGAKVDGINVEDFMSRNFIANPRCAVQSIDNSKKKPRIRINAVLAGGQSKASKVHQEFDLIYHRPLPIDAQIQNGKILRTRVGDKFKYDLVLTLKIPDKEPISYNNLKGTIGIDIGFRRSVNSLLIGTVMSSNVSEKAYEIKVPPKIVEAFEHVIDLKSELDDAATDLGRIITPLMKAHPLDEDHSKYKMWRSLALRPAHVTLSFEQAYKLAIWLKHEPDTFPEEITKKVHTWWRSYSRKYRELHNRRRNQLTHRKHFYREEAAKIVALNKLIVLEEINLTDFAETKEKNTKLSKKARAQRFMASLSEFRDAIKNAAQRDGIGIIDVNPAYTSKTCSECGNLNKDLRSEKQWSCPACGVVHDRDENAANNLQKMGQTYLESLKKETSEVIE

SEQ ID NO: 16 - protein, 586 aa, Unknown
  source: /note="Description of Unknown: aquatic-marine-pelagic marine sequence"
MATRVYKYGLIPIGYPAKETIDELFKANVLWNNLVALHRKNREDWDDARRAASVLYSDKIDDLEKKEEDLDAAWKAFQQARMDEGTRDETNNKRLKSERASINRLDTEKAEIYKELKPLRKEADKEIDKKQLNDAYRTKVNEAVSVRNSGIYSATAGQILENFKTARDRSFKESATTLRFHRFDGTGYYQFRCRRKGTNVDGISIDDFMSRNFEANPRCAVQSIDNRKKKPRIRIDAVLVGGQSKASKIHQEFDLIYHRPLPIDAQIQNGKILRTRVGDKFKYDLVLTLKIPDKEPISYNNLKGTVGIDIGFRRSVNSLLIGTVMSSDVTEKAYEIKVPPKIVEAFEHVIDLQSELDDAATDLGRIITPLLKAHPLDEDHNKYKMWRSLALRPAHVTLSFEQAYKLAIWLKHETDTFPEEITKKVHTWWRSYSRKYRELHNRRRNQLTHRKHFYREEAAKIVALNKLIVLEEINLTDFAETKEKNTKLSKKARAQRFMASLSEFRDAIRNAAQRDGIGIIDVNPAYTSKTCSECGNLNKDLKSEKQWSCPACGVVHDRDENAANNLQKMGQTYLESLKKETSEVIE

SEQ ID NO: 17 - protein, 592 aa, Unknown
  source: /note="Description of Unknown: aquatic-marine-seawater sequence"
MWCEINMATRVYKYGLIPIGYPPKETIDELFKANVLWNNLVALHRKNREDWDDARRAASILYSDKIDELEKKEEDLDAAWKAFQQARMDEGTRDETNNKRLKSGRASINRLDAEKAEIYKELKPLRKEADKEIDKKQLNDAYRTKVNEAVSVRNSGIYSATAGQILENFKTARDRSFKESATTLRFHRFDGTGYYQFRCRRKGTNVDGISIDDFMSRNFEANPRCAVQSIDNSKKKPRIRIDAVLVGGQSKASKIHQEFDLIYHRPLPIDAQIQNGKILRTRVGDKFKYDLVLTLKIPDKEPISYNNLKGTIGIDIGFRRSVNSLLIGTVMSSDVTEKAYEIKVPPKIVEAFVHVIDLQSELDDAATDLGRIITPLLKAHPLDENHSKYKMWRSLALRPAHVTLSFEQAYKLAIWLKHEPDTFPEEITKQVHTWWRSYSRKYRELHNRRRNQLTHRKHFYREEAAKIVALNKLIVLEEINLTDFAETKEKNTKLSKKARAQRFMASLSEFRDAIRNAAQRDGIGIIDVNPAYTSKTCSECGNLNKGLRSEKQWSCPACGVVHDRDENAANNLQKMGQSYLESVKKETSEVIE

SEQ ID NO: 18 - protein, 577 aa, Unknown
  source: /note="Description of Unknown: aquatic hot springs metagenome sequence"
MIKAFKYGMLEPVAGFDKAAIDVLYLRNKLWNSLVELEKAHRERYRTLITGSDDELSKIQARLDQIEAERAELVKRKRQARAMVRSKKVDTSEHDDRIDMLMAERNDLRTKAKDIRLQVKEKVKPAIADLEKERYEAVKHLIHEAGLWWCNSETVIAAYDLARVKAMKENAELRFRSFDGSGKFAVRKTGGFALSDLVSGKLSFARLEALPDANFAHLSERGKRSRARHHLTMTILTYKDESGKLCRHEVTWPIILHRPLPPEGMIKFIHVQRKRIGKDFQWTCSITMEVDEIQKTPIDHPSRAACGIDIGYRLVKDGLRVAVIADTSGKIDHLTLPQDWIEKMDHVESIQGHLDNSNDLAWGELKALLKSMHDYPESIAESIGRLLKAGDRTPVRGMRALHWRLRNEPETMPEVLSILDTWEAETCRREREMHRLRRKLINRRKDLYRNFAYKVANRYVLIRIRGLSLKKLAAVNLEDGSDNQMPQAVRNNRTRASLSELTLCLQQAAVKAGADFEKVFDVNSTTTCSTCGNQNLKMDREDIYFRCEKCDTLHDQDENAAKNLLRKEFYLAEQAVM

SEQ ID NO: 19 - protein, 614 aa, Unknown
  source: /note="Description of Unknown: arthropoda-digestive system-termite gut sequence"
MENHKFTIPDQANQGIIVYEYGIRLDKESKPLVWQQIQLSRKLYNNIVASMRQTFDAMNTFILERAGDEGKQLNQAIEEGIERFKTAKAEQNEDDIKETVLFLREKRAKLSEQLKGVRTQYKEETKRNFFNRIGMRTSCETYQIRSQAVKDGLGWATANEVLNSALKAFQARIKTGQPPKFAVGEEKQQDSLRTQFTQAGGCPVATLFESEHSGLSLRAAAGFGRRKYGTFRFRLGEAKSDVWATGTCQFHREIPSGATVASAALVQRRIGRDLKHALQLVVKLPQQAEAQATQSKKFCTVHFGWASEEGIQYVMALADQENPTKAQLFQLPTDIETDFNRVENLASQRSKLLNDLVLQIKSGSIVIPSQIKEVADEFDAIKRLPATHISLTRLHRICRLMIESDIFRPEALERWRRQDRLLLQDIAHIRRRALYRRRDFYRVTASVIAKSYGAIVIETLDLKKANTKINMVTGEKSDKNKKSRSRQRMAALHELQRQLRQAAGKAGCVIIELTGEKTTATCAFCNREGTTTTSESSQVLHCPHCGSQMNRKQNGAAVAWQLASPIIDDLVHEARSLAAVQSSERAASKILKAEKVATARKANRAAREPAATDK

SEQ ID NO: 20 - protein, 631 aa, Unknown
  source: /note="Description of Unknown: groundwater metagenome sequence"
MIVQITPAPLPQGDVRIYEFGARLDHDCVRTVDEQIFKAHQLYNQLVACMQTTVRDMQAYLLDHAGPDAHAAKARVDGLNEAFNAARAANDENRMTTVATERREAWRALAAVLRIARKEHRTAMQETFLSRIGKKSACETYQLRCKAVADGLGWATANATLDAALIAFKKSFALGRAPRFARIADSIQDTLTLQFTAAGGINIERLLDGKHTELALKPPAVCGKRGYGTFAFRLGAASAETQATGTWQYHRPLPPGGTVGLARLVRRRIGPKTTWSLQLQVRSPLPEREHEDRRPLVTVHPGWAADLSGRRIAGIADAADPGLATVLQLPPDIEHGLQRAAELESTRSQARDALTPMLKVHPWPQELLNAATPEEDASASGDSGPMAPERIMCRKVADEILALRRLPAQHIAIRRLHRLARWLRLAEVDVPDWLETWRKEDKLRWQASAAAAKRARNRRRGFYRETALRLASQYQAIVIEPLNLADAAKKIDEATGERSDFAKKARAGRVVAAIFELDSAIRWAATKCGTAVLDLTGETAQHCAICGGHSLKADDEDSQCLRCSDCGADIDRKRNGAALAWQAAAAHLETHLEDFWRLTLENRASAAAKRDEKKTKLQEGRRAAMRETLET

SEQ ID NO: 21 - protein, 575 aa, Unknown
  source: /note="Description of Unknown: groundwater metagenome sequence"
MIKAYKFGLLNPISGFDQAAMDVLYLRNKLWNQLVELEKNSRAAYRALMLDSSEELSVIQTRIDAIEVERADLVSQKKKLRASVRSKKVDTAGIDAAVERLIAERTNLRAKAKQLREVVKVEIKPKAVELDKVRYAAVLALIKGSGLWWGNSETVIAAYDVARVRAMKESAELRFRSFDGTGKFAYRESGGIDFDKFMSGKVNFARLNTLPDSDFAHLSERGRRSKARHHLTMTVLTSVDDAGKKVRHEVTWPIVMHRDMPAGAIKTIHVHRKRVGDQFNWTCSITIDVPEEPKQLIDHPAKAACGIDLGFRLVKDGLRIATIADSDNRIEHVVLPLDWIEKMDYVEHLQSTLSETANLTWVRLRKHLSELPDYPESIKERIHNILKAGERVPTRGMRSLLGALKAEPELLPEALQILAAWSDDIYRPAREMHNLRDKLMKRRQDLYRNVSHCLSNKYAMVRVEDMDLRQIARVKKDDGSDNPLPDTVRDNRKRAALFEFVLSIKQSCVKTGSVFEKMNPAYSSMTCSSCGHLNQPGMDIHYSCENCGTLHDQDENAAKNFLRGEYFSSPKQDVA

SEQ ID NO: 22 - protein, 579 aa, Unknown
  source: /note="Description of Unknown: soil metagenome sequence"
MKKITIRKYGARLLGDSEPIIVKSMRDQNTLWNKLVEIERANTTEYRDIVAQSDDVLAALTQEYAAAEQRLKDVQEMRNRVRAAKRSKQIEGAENYAAEIKAISSSLKDLRARMKECRARAKEAAKPRLEGLEDRRRAAVKQATNEAAIWWAHSELVTNSFDVARVKALKSNAELRFHRFEGEGRIGVRIQDGILLGNQKGTSMLQVREATPEELGHLQAQRARKRLVAVDIRVGKRGEDGHIPKATFLVTIHEGMELLPNTPLKTVTVKREMHAGQPKWFMVFMFVESDAEPEDKPLPPKAVGVDFGWRVVKDREWGERTGLRVATIANKDGTKQHITLPPELLARFERSTRLRSELDVAANEFWVRTASLFTDDILATLSEDEWLRVLVGKAKRAHRPYPSLMEAITRAHAANPVLGPEADEQMQAWARRARRLNVAAFGARRKAADHRKHLYRNVAARLVRECGLIAIKDTDFHKLAKLVDDDGKETELNKHARANRFMASPSELRQAIKMAALREQRELVNVAPAHTTTTCSACGHVHGERPKDLIFVCDSCGKWHDQDENSAAICLKIALESKL

SEQ ID NO: 23 - protein, 621 aa, Unknown
  source: /note="Description of Unknown: terrestrial-soil-pond soil sequence"
MNDVTLSFRGLEPRESTSWSYGARVAGSEALEEQYTLAQRTYNNMVEVTRQALAAFNEWFAEKDPEIARLGTEIERLGAQWAEAKARDDRDELARIAAERRPLRQQWYERCFAVRKDNRGEVNALLKQWVGSAKESRLYLARVEAVKAGLYWATATAVMTAVQRAWDKQFPRLRPVAFSRRSEKRRETLVVQFTESGGVAMETLHTKHGGLWIEPPGEGLLSAWANGRRPGRPDRYLRFRMRIGGRGREGVYVEGSVQMVRPVPEGARVMMARLVRERVATRYRYQLQLVLRLAEPLSIPAEDKAPRVALDIGWYYEAGRGRRVIAYTAGANEDAVEQIYLDPSIDEAFDRVDDMNSRRSLARDDVTIALRCCQWDGAPEALAEALSAINRLPVAHVSPARLAQMVWLWREHHGDYRPDVLEELWAWRRWDKKLYETSAHLRRRTAGRRKKFYEGWARHFASRYATIVVVRPDLREAAMVKNAISGEHTALTARARQGRVRAALYEFLNVVATKAAEAGSVVIELTGRTTTECSACGEIMVVPEDNPATRLLVCHACGVSHDREANSAVLAFRVLDDEASVTKGLAHAQEKADKARERRYKRRTAMRDARWKDEQTTTSGQ

SEQ ID NO: 24 - protein, 632 aa, Unknown
  source: /note="Description of Unknown: terrestrial-soil-pond soil sequence"
MNQSPPANGECMENVTLSFRGLEPRESTSWNYGARVEASEALEEQFTLAHRTYNQMVEVTRHALAALTDWFCEKDPEIARLGAAIERLSAQWSEAKARDARDELEQIAAERRFLRKDWYERCFAVRKDNRSEVNALIRQWVGLTKESRLYAVRTEAVKAGLYWASATAVMTAVQQAWDKQFPRLRPVAFSKRAEKTRETLVVQFTEAGGVPMSTLHSKHGGLWIEPPGDGLLTAWANGRRPARPDRYLRFRMRIGGRGREGVYVEGSVQMVRPVPEGARVMMARLVRERVATKYRHQLQLVLRLAEPLSIPTETKEPRVALDLGWYYEAGLGRRVIAYTGGDNEDAVEQIYLPPGIDEAFDRVDDMNSRRSLARDDVAITLRCCQWDDAPAPLAETLAAINKAPVAHVAQARLARLVWQWRNEHSDYRPDVLAELWSWRRWDKKLYEASAHLRRRTAGQRKKFYEHWARYFASRYTTIVVVRPALREAAVIKNEASGEHTALTARARQGRVRAALYDFLNAVATKAAETGSVVIEVSGRTTTECSACGAIMAVPEENPATRTLVCHACGVSHDREANSAVLAYRVPDDDGAVTQSLEHAQEQADRARERRERRRQAMREGRWKGKQSAGGGD

SEQ ID NO: 25 - protein, 621 aa, Unknown
  source: /note="Description of Unknown: terrestrial-soil-pond soil sequence"
MENVTLSFRGLEPRESTSWNYGARVEASEALEEQFTLAHRTYNQMVEVTRHALAALTDWFCEKDPEIARLGAAIERLSAQWSEAKARDARDELEQIAAERRFLRKDWYERCFAVRKDNRSEVNALIRQWVGLTKESRLYAVRTEAVKAGLYWASATAVMTAVQQAWDKQFPRLRPVAFSKRAEKTRETLVVQFTEAGGVPMSTLHSKHGGLWIEPPGDGLLTAWANGRRPARPDRYLRFRMRIGGRGREGVYVEGSVQMVRPVPEGARVMMARLVRERVATKYRHQLQLVLRLAEPLSIPTETKEPRVALDLGWYYEAGLGRRVIAYTGGDNEDAVEQIYLPPGIDEAFDRVDDMNSRRSLARDDVAITLRCCQWDDAPAPLAETLAAINKAPVAHVAQARLARLVWQWRNEHSDYRPDVLAELWSWRRWDKKLYEASAHLRRRTAGQRKKFYEHWARYFASRYTTIVVVRPALREAAVIKNEASGEHTALTARARQGRVRAALYDFLNAVATKAAETGSVVIEVSGRTTTECSACGAIMAVPEENPATRTLVCHACGVSHDREANSAVLAYRVPDDDGAVTQSLEHAQEQADRARERRERRRQAMREGRWKGKQSAGGGD

SEQ ID NO: 26 - protein, 612 aa, Unknown
  source: /note="Description of Unknown: wastewater metagenome sequence"
MKSTPDTISITPGATANGDMLTYEYGLRLDKESIAHVGAQIAMSRRLYNDLVAQIRTTVDALQAFVIDKAGDEAVQIKVRIEELTTNFKAAKAEDNEPEMKRIAEDRRNQWKLLSALIKAASKANRAEINERFLSKIGKNSSCPTYQLRGKAVAEGLGWGTANAVLDAALQAFKTSFALGRAPRFASGAEIDQDCLFLQFTAAGGVASASLLAGKQADLQLLPTNGCGKRKYGEFKFRLGAAKADTYATGTWQYHRPLPDGSNIALARLVRRRIGMHDKWAIQLLVKPKTPIRESVEERKPLVAVHFGWAADIAGRRVAAIADAADPGAATILALPPSIEEALDRAREIQGVRDKSRDEIAPQVRSIEIPGSANETLIDLLGRVRKTRPQDISANRIHYLCRLLREADHLPDWLEAWRKEDKNRWQDQAHIAKRARNARKSFYREVAINLGRQYDAIAIEPLDLASAAMKVNEATGEKTDFAKKARAGRVVAALYEFESAIRWAATKTAAALIEVSGATASVCSVCGGHVEATKDDHQSIVCHDCGAVLDRKQNGAAIAWQSANDKREDVVTEFWSEYFADSEAKKEKKAEKLAKMAEGRRNARTESAAEIA

SEQ ID NO: 27 - DNA, 37 bp, Artificial Sequence
  source: /note="Description of Artificial Sequence: Synthetic oligonucleotide"
gtttcatcggccatcgcggcggcctcgtagctgcgac

SEQ ID NO: 28 - DNA, 27 bp, Artificial Sequence
  source: /note="Description of Artificial Sequence: Synthetic oligonucleotide"
gtttcatcagccattgcaggggctttg

SEQ ID NO: 29 - DNA, 36 bp, Artificial Sequence
  source: /note="Description of Artificial Sequence: Synthetic oligonucleotide"
gtgttatgcccatctcagcgggctggttgctgagac

SEQ ID NO: 30 - DNA, 25 bp, Artificial Sequence
  source: /note="Description of Artificial Sequence: Synthetic oligonucleotide"
gttatagtggccattgtaggggctt

SEQ ID NO: 31 - DNA, 36 bp, Artificial Sequence
  source: /note="Description of Artificial Sequence: Synthetic oligonucleotide"
ggtttaaggcgatcacggccgcctagttgccgcgac

SEQ ID NO: 32 - DNA, 37 bp, Artificial Sequence
  source: /note="Description of Artificial Sequence: Synthetic oligonucleotide"
ggtgctcaagccatcgcagcggcatcgttgctgcgac

SEQ ID NO: 33 - DNA, 29 bp, Artificial Sequence
  source: /note="Description of Artificial Sequence: Synthetic oligonucleotide"
gagcggttaacagggtgtcgatatagatt

SEQ ID NO: 34 - DNA, 37 bp, Artificial Sequence
  source: /note="Description of Artificial Sequence: Synthetic oligonucleotide"
gtaacaacagccattaccctggcttagtaagggtgac

SEQ ID NO: 35 - DNA, 34 bp, Artificial Sequence
  source: /note="Description of Artificial Sequence: Synthetic oligonucleotide"
agtagaaccctgtcgcttgggcggtaaagcgaac

SEQ ID NO: 36 - DNA, 36 bp, Artificial Sequence
  source: /note="Description of Artificial Sequence: Synthetic oligonucleotide"
gattaaggcccctgtgcattggggtgtaaatgcaac

SEQ ID NO: 37 - DNA, 36 bp, Artificial Sequence
  source: /note="Description of Artificial Sequence: Synthetic oligonucleotide"
gtctaaggcccctgtgcattggggtgtaaatgcaac

SEQ ID NO: 38 - DNA, 36 bp, Artificial Sequence
  source: /note="Description of Artificial Sequence: Synthetic oligonucleotide"
ctttaaggaccctgtacgttggggtgtaaacgtaac

SEQ ID NO: 39 - DNA, 26 bp, Artificial Sequence
  source: /note="Description of Artificial Sequence: Synthetic oligonucleotide"
ggtatcatgaccctacgggtgggggg

SEQ ID NO: 40 - DNA, 29 bp, Artificial Sequence
  source: /note="Description of Artificial Sequence: Synthetic oligonucleotide"
agccatcgcaggggcttggtgcttgcgac

SEQ ID NO: 41 - DNA, 36 bp, Artificial Sequence
  source: /note="Description of Artificial Sequence: Synthetic oligonucleotide"
attccaaggcgatcacagccgcctagtagttgtgac

SEQ ID NO: 42 - DNA, 37 bp, Artificial Sequence
  source: /note="Description of Artificial Sequence: Synthetic oligonucleotide"
gttttagaaccctgttgagtgggcataaactcaaact

SEQ ID NO: 43 - DNA, 26 bp, Artificial Sequence
  source: /note="Description of Artificial Sequence: Synthetic oligonucleotide"
ggtatcatgaccctacggatgggggg

SEQ ID NO: 44 - DNA, 36 bp, Artificial Sequence
  source: /note="Description of Artificial Sequence: Synthetic oligonucleotide"
gattcatagccctgtcggttgggcggtaaaccgaac

SEQ ID NO: 45 - DNA, 37 bp, Artificial Sequence
  source: /note="Description of Artificial Sequence: Synthetic oligonucleotide"
gtctcaatagcgatcggcgccgcttagtagggtcgac

SEQ ID NO: 46 - DNA, 38 bp, Artificial Sequence
  source: /note="Description of Artificial Sequence: Synthetic oligonucleotide"
ggtaacaatagcgatcggcgccgcttggtagtgtcgac

SEQ ID NO: 47 - DNA, 37 bp, Artificial Sequence
  source: /note="Description of Artificial Sequence: Synthetic oligonucleotide"
atctcaatggccatcgtcggggctttgtaccggcgac

SEQ ID NO: 48 - protein, 567 aa, Clostridiales bacterium
METAATKNYLALSFGCLSPTRGEEYLLDQIKKKHDLWNKLVEKDREHREKVRQVMVFESETTKKIKELEEELNSLREEIKNQRKTKRTGKVDLTDQKARIEEIKPQLKQLKEKFKEERSFIFEARKQELAQLEKERWAVVKELGKGSGLYWCNLEDVVNSYDIGRKKAKAAGGEMRFHRWDGTGKVTVRFQKGLPVNEMFSCTNNLLQIDPVDKDAWYNPVRAIRRKKSRTRVRLRACSENKKPLFIELPVVLHREIPEDALIRTASVIREKVGMRYRYKLNLVLEILGENTNRILPALEGTAAIDLGWRTVKDGLRVACLVDDKGHSEELILDNDVLHEFNKIKDLQSIRDNLFNETKAKLMELLKTLELPDEAKERTSHMANWRSQQKMLRLHQYWRENRLPGDDEVWEVLEYWRKREIHLYEWQENLRDQVLRRRKEIYRIFAAKITRKYKTIVLEEFTLNKTVQKPNPEEGPAGTLPANRNRFIAAISEFRNELANACRKNHVEFTYVPAENTTITCHKCGHKEKFDAAAQIIHTCSTCGELWDQDYNAAKNLLAFSQKGGVK

SEQ ID NO: 49 - protein, 594 aa, Clostridiales bacterium
MSRLEARTRYLQAGQKRLGKIRKRGFFMETAATKNYLALSFGCLSPTRGEEYLLDQIKKKHDLWNKLVEKDREHREKVRQVMVFESETTKKIKELEEELNSLREEIKNQRKTKRTGKVDLTDQKARIEEIKPQLKQLKEKFKEERSFIFEARKQELAQLEKERWAVVKELGKGSGLYWCNLEDVVNSYDIGRKKAKAAGGEMRFHRWDGTGKVTVRFQKGLPVNEMFSCTNNLLQIDPVDKDAWYNPVRAIRRKKSRTRVRLRACSENKKPLFIELPVVLHREIPEDALIRTASVIREKVGMRYRYKLNLVLEILGENTNRILPALEGTAAIDLGWRTVKDGLRVACLVDDKGHSEELILDNDVLHEFNKIKDLQSIRDNLFNETKAKLMELLKTLELPDEAKERTSHMANWRSQQKMLRLHQYWRENRLPGDDEVWEVLEYWRKREIHLYEWQENLRDQVLRRRKEIYRIFAAKITRKYKTIVLEEFTLNKTVQKPNPEEGPAGTLPANRNRFIAAISEFRNELANACRKNHVEFTYVPAENTTITCHKCGHKEKFDAAAQIIHTCSTCGELWDQDYNAAKNLLAFSQKGGVK

SEQ ID NO: 50 - protein, 607 aa, Gordonia otitidis
MTRVTVQTAGVHYKWQMPDQLTQQLRLAHDLREDLVTLEYEYEDAVKAVWSSYPAVAALEAQVAELDERASELASTVKEEKSRQRTKRPSHPAVAQLAETRAQLKAAKASRREAIASVRDEATERLRTISDERYAAQKQLYRDYCTDGLLYWATFNAVLDHHKTAVKRIAAHRKQGRAAQLRHHRWDGTGTISVQLQRQATDPARTPAIIADADTGKWRSSLIVPWVNPDVWDTMDRASRRKAGRVVIRMRCGSSRNPDGTKTSEWIDVPVQQHRMLPADADITAAQLTVRREGADLRATIGITAKIPDQGEVDEGPTIAVHLGWRSSDHGTVVATWRSTEPLDIPETLRGVITTQSAERTVGSIVVPHRIEQRVHHHATVASHRDLAVDSIRDTLVAWLTEHGPQPHPYDGDPITAASVQRWKAPRRFAWLALQWRDTPPPEGADIAETLEAWRRADKKLWLESEHGRGRALRHRTDLHRQVAAYFAGVAGRIVVDDSDIAQIAGTAKHSELLTDVDRQIARRRAIAAPGMLRAAIVAAATRDEVPTTTVSHTGLSRVHAACGHENPADDRYLMQPVLCDGCGRTYDTDLSATILMLQRASAATSN

SEQ ID NO: 51 - protein, 591 aa, Gordonia otitidis
MPDQLTQQLRLAHDLREDLVTLEYEYEDAVKAVWSSYPAVAALEAQVAELDERASELASTVKEEKSRQRTKRPSHPAVAQLAETRAQLKAAKASRREAIASVRDEATERLRTISDERYAAQKQLYRDYCTDGLLYWATFNAVLDHHKTAVKRIAAHRKQGRAAQLRHHRWDGTGTISVQLQRQATDPARTPAIIADADTGKWRSSLIVPWVNPDVWDTMDRASRRKAGRVVIRMRCGSSRNPDGTKTSEWIDVPVQQHRMLPADADITAAQLTVRREGADLRATIGITAKIPDQGEVDEGPTIAVHLGWRSSDHGTVVATWRSTEPLDIPETLRGVITTQSAERTVGSIVVPHRIEQRVHHHATVASHRDLAVDSIRDTLVAWLTEHGPQPHPYDGDPITAASVQRWKAPRRFAWLALQWRDTPPPEGADIAETLEAWRRADKKLWLESEHGRGRALRHRTDLHRQVAAYFAGVAGRIVVDDSDIAQIAGTAKHSELLTDVDRQIARRRAIAAPGMLRAAIVAAATRDEVPTTTVSHTGLSRVHAACGHENPADDRYLMQPVLCDGCGRTYDTDLSATILMLQRASAATSN

SEQ ID NO: 52 - protein, 597 aa, Gordonia otitidis
MHYKWQMPDQLTQQLRLAHDLREDLVTLEYEYEDAVKAVWSSYPAVAALEAQVAELDERASELASTVKEEKSRQRTKRPSHPAVAQLAETRAQLKAAKASRREAIASVRDEATERLRTISDERYAAQKQLYRDYCTDGLLYWATFNAVLDHHKTAVKRIAAHRKQGRAAQLRHHRWDGTGTISVQLQRQATDPARTPAIIADADTGKWRSSLIVPWVNPDVWDTMDRASRRKAGRVVIRMRCGSSRNPDGTKTSEWIDVPVQQHRMLPADADITAAQLTVRREGADLRATIGITAKIPDQGEVDEGPTIAVHLGWRSSDHGTVVATWRSTEPLDIPETLRGVITTQSAERTVGSIVVPHRIEQRVHHHATVASHRDLAVDSIRDTLVAWLTEHGPQPHPYDGDPITAASVQRWKAPRRFAWLALQWRDTPPPEGADIAETLEAWRRADKKLWLESEHGRGRALRHRTDLHRQVAAYFAGVAGRIVVDDSDIAQIAGTAKHSELLTDVDRQIARRRAIAAPGMLRAAIVAAATRDEVPTTTVSHTGLSRVHAACGHENPADDRYLMQPVLCDGCGRTYDTDLSATILMLQRASAATSN

SEQ ID NO: 53 - protein, 536 aa, Meiothermus silvanus
MPFGKKARHVKAYQFGADAPQEGMEAVLEQHRLRTDYYNALVEMELRQREERTALLANLAAESGLESPNQVYERLKAAGEKGIRKHPEYVAARERQKALYGHPRLLELQSRQREERNALRRSFGAKGLYSSNYLDVERAFDKARQSPELRFRRYSPHEGRLAVLYTEGLPMREIGSDTRVQLPLPDPIIYRDRATRRKHQRVLMKFRVRSVERQPLWITVPVYLHRELPDGVCREVSLHWHRVADRLRWTVSVVVEVEGPPVASPTGRGAVAVDLGWRRVEGGLRAGFWVGEDGAGGEIALSEGDLKQFSKVEDLRSIRDQHLNALKEALAAWLEAPPAPLPDWLAEETKTLPQWRSPARFAALFRRWQSERVHADEAAYGLLEGWHKRDRHLWQYEANLREQMILRRREQYRVLAATLARQYDALIVEDFNLRAAAELDQGGSDLPDAARRYRTIASPSTLRDALVNAFAQRGKPVRKLNPAHTTTDCHACGGALVGDPAKELRLYCPTCERFYDQDENAARNLLRRAQEVQAQV

SEQ ID NO: 54 - protein, 589 aa, Methylomonas koyamae
MIRTYKYSLKAPENFAEDCEDELRRMNDLWNRLIEIDRQRERSFKDLCRSTSAEYAAAQDEIEALREPIDNLYDAIRAERIATRSKEPSDELRARRDELLGRRKALWEICKAIQKAIPKESQAPINEVYKTNVKLARQQSGCFWGNYNAVIESFETAKSKAIKDGGRLHFKSFDGSGRFVNQIQGGMTVTELLAGSHSQAQLTNLVTTNKTKGRFAFTAFTGKDDAGKRFRRQLFSEINYHRPIPADGVIKAVEVVKVPHDGKQKYKWHACFTVALPEVDIKHPKRNIAGVNLGWRQFGGRLRVAVVVDDAGKKTEYFVPAELVSKFEAAETIQKAADDARNEMLSWLRTFYQDNRDEAPQEWRESIQGLLRNRPSVDAANHLMTIWRECVFAQEESRRYAAWLKSDAALRRSYTGCRQNAVKWREEIYRHIAKELAERYAVLAVTDTPLSTMSRTKAKDDLAVDNALPESARRNRVIAAIYSLKEWIGKQAAKTGSTVETITGKMTATCHKCGYVAEKRLRGSQYATCKSCGSELELDENAAINCRNHASGAVLISDKPEKTGRFQRAKMAENDFARKIGDNASPLVT

SEQ ID NO: 55 - protein, 603 aa, Mycobacterium conceptionense
MAITVHTAGVHYRWTDNPPEQLMRQLRLAHDLREDLVTLQLDYETAKAGIWSSYPAVAAAETELADAESAAEQAAAAVSEERTKLRTKRITGPLAQKLTAARKRVREARSTRRAAISEVHEEAKGRLVDASDALKAQQKALYKTYCQDGDLFWATFNDVLDHHKAAVKRIGQMRAAGQPAQLRHHRFDGTGSIAVQLQRQAGQPQRTPELIADVDGKYGRVLSVPWVQPDRWERIPRRERRMIGRVTVRMRAGQLSGEPQWLDIPVQQHRMLPLDADITGARLTVTRTAGTLRAQISVTAKIPDPEPVTDGPDVAVHLGWRNTDTGVRVARWRSTEPIEVPFDFRDTLTVDPGGRSGEIFVPEAVPRRVERAHLIASHRADRMNELRARLVDYLAETGPRPHPSREGEELGAGNVRMWKSPNRFAWLARVWADDESVSTDIREALAQWRHQDWISWHHQEGGRRRSAAQRLDVYRQVAAVLVSQAGRLVLDDTSYADIAQRSATTKTEELPNETAARINRRRAHAAPGELRQTLVAAADRDAVPVDTVSHTGVSVVHAKCGHENPSDGRFMSVVVACDGCGEKYDQDESALTHMLTRAVQSAA

SEQ ID NO: 56 - protein, 596 aa, Mycobacterium mucogenicum
MTTMTVHTMGVHYKWQIPEVLRQQLWLAHNLREDLVSLQLAYDDDLKAIWSSYPDVAQAEDTMAAAEADAVALSERVKQARIEARSKKISTELTQQLRDAKKRLKDARQARRDAIAVVKDDAAERRKARSDQLAADQKALYGQYCRDGDLYWASFNTVLDHHKTAVKRIAAQRASGKPATLRHHRFDGSGTIAVQLQRQAGAPPRTPMVLADEAGKYRNVLHIPGWTDPDVWEQMTRSQCRQSGRVTVRMRCGSTDGQPQWIDLPVQVHRWLPADADITGAELVVTRVAGIYRAKLCVTARIGDTEPVTSGPTVALHLGWRSTEEGTAVATWRSDAPLDIPFGLRTVMRVDAAGTSGIIVVPATIERRLTRTENIASSRSLALDALRDKVVGWLSDNDAPTYRDAPLEAATVKQWKSPQRFASLAHAWKDNGTEISDILWAWFSLDRKQWAQQENGRRKALGHRDDLYRQIAAVISDQAGHVLVDDTSVAELSARAMERTELPTEVQQKIDRRRDHAAPGGLRASVVAAMTRDGVPVTIVAAADFTRTHSRCGHVNPADDRYLSNPVRCDGCGAMYDQDRSFVTLMLRAATAPSNP

SEQ ID NO: 57 - protein, 664 aa, Pelobacter propionicus
MKRVTITIDGEQTKGIVIGTIAANHTAAEWLLTASVSAKSAKVRFDPEEAVAETSSLVMIAPTRTEKYLYLVPDEQVQPVTTIVRKYGLLSPLDWDCPDYPAGDAFEHLFLQNKLWNDLVTIEREHRAKYRELIGSDEETAQMDTEIASIKDRLSVLDEGRKKLRVEHRKKKCPEIDCLDENIKKLKSELKAVASKAKETRAAAKDRIRAAGNDIENLEKDRQAAVIKAYNNSGLWWGNYNAVLESYKKARIKALKDGAELKYHRFDGSGRFTNQIQGGMSVQDLLEGNRNVASLRLVSSGELGDISGKKPPSLDLQSVGSRRDSREYGILAITLYTGTDEQSKKFRRTLSFPVILHRPLPEGATLKSLSVHRKRVGTDFVWSVVFTFTTDCPTYDQRSSTGNRCGLNLGWKKQAGGGLRVATIYDGSDARHITLPQAIIDGLDYVNGDLQGRIDSAANENHAWLLEQWGGDELPESLQELRSMLRRSKRPHPAKFAKAVIAWRNYPEYLGDARDEAEQRRKATKRLTIEMAHKREKLLRRRMDFYRNTAKQLTSVYDVICLDKMDLRRLALLEKGDGTPNELTKIARKQRQQAAISELRECLSKAAAKNGTQIEQVSTASSATCSACKGKMEQVDGIMWRCRECRALVDQDINAAANLFREVL

SEQ ID NO: 58 - protein, 599 aa, Thioalkalivibrio thiocyanodenitrificans
MKRQQEDTEALVYAYGARIPLDDPHLQEELRKQRAFWDALVEATLAAERELDDRMKADSPQYAAAVQALIDASQAVREAIERRNAERAKTRSRTTSVDGEVKERITEKNAARKEVWRLAGEWRKANKEAVSEHQARMKEEAKRLRQGCGLYWGNYNRVLDSFQRARQQTLKKGRRVRPSDPARDDGILAVQIQRTKSGLGASPEELFSGNVSQLQIDRPPPGVEFLPANRRRREARVTARMRVDAAGHMIEFPVVLHRPVPPGARIKAAQLVWKREGERWRGQLCLTVSSPKQEREHPGVEACGIDLGWRLQKDGALRVATVADSKSRLYTYTLPADWMRGMDQVERLSSHLDENAMEVAAWVHAHRDELPEKLTQPAANWSPGKGSKWLRDKELHDAVRALNWEVPAEIRHWYERYRHLKTWRDNLRAKLLRSRREVYRLLAADLAGRYAVIGIEDMDLSKIAKTKKRKDASDPELHATARAQRQRAAVHALRHEIEHQANKHGAQLVHVSGKTTTTCRACGAATGQKDRASLIWTCEHCGAVWDQDLNAAGNILDSAMGASAPAATTLAKAKSRRYDLTQPNFRERSKTGSRASARA

SEQ ID NO: 59 - protein, 636 aa, Unknown
  source: /note="Description of Unknown: algae-green algae-macroalgal surface-ecklonia radiata 2 sequence"
MPVINWVYRSEEPTNVAAVKNQILLNHRYRNQLIELEHNRRATYKTLAASLCPAYADAVTIYDRAVAELDEAYKDLRLSRQRARRRHEPTDSQKARINQAKAVRKTAIAQLDAAYKVAKKLIRDAHKVYQDQAAQEITQLADETESQLKRQRKVRYFELVEEAGLDDGQIAHAREAKIARQQSGVYWGTSRIMEQIAEKTYKKGPPPKFRRWEGSGAIGVRFQGGKPVAAVMENNSEILHIHIPPGSERLVIGQDRGEVAKGTIRFLVCRDDDGNPVFATFPYVHHRDFPASAKIIDGFAHLKRVGKKEYWEIRLTIKVDDVVSTVDKSNTCVLHLGHRMIDEQLRCATVMDATQQVSQLFLSSDKLRRFSRPDSLQGIRADRFNIIRGEFLDWLASIDVPEWLVERTQTLASHQSPESLYRTVELWRDNRFVMDTETSAQFFTNSLPWAESKLNSPAVRRKRHPSDIQTVFGIMEFWRSWDRHILQESASINKKAIRNRKHVYRDWLRRLSGRYTHLIVDSTNWATLGKKEKDDEKVVLVANQRRLARIASPGLLRQCAVEIFGQSNVSVVTSVNMTRTCSTCGQVTEDWDSAKLEYHCSHCTYTVDQDINAANIMLSRIPDAVPYTEFAEAKRR

SEQ ID NO: 60 - protein, 592 aa, Unknown
  source: /note="Description of Unknown: anaerobic digester metagenome sequence"
MITVFKYGVHYRWQVPEVLREQLWLGHQLREDLVTLQLEYEAGLKAIWSSYPDVAAAEESLATAAAEALEAAEEVSRQRQVQRTKRITGPAADALAAARKRAKEARVVRRSAIAAVKDEAAERISALAAGLRASQKAKYAEYAQGKGLYWATFGDVLDHHKTAVKMVAAKRAAGRPAALRHHRFDGTGAVAVQLQRPAGKPQRTPALISDPVASNWRNVLHLPWVDPEQWEQMTRAEQRAQGRVIVRMRCGADIIEVPVQVHRMLPADADITGARLVVAREGSDYRISLTVTARIGDPEPVTAGPTVALHFGWRGSDAGPVVVRWQSDAPVDIPNDCSAFMVGDRWGGKIVMPSVIVDRLESAAAIQAGRDEQLNTVRAAVVEWLTVNGPVPHPIRDGEEISSADASRWRRPARFAALAGWWRDAPPAGGEQIAEVLEAWRASDKRLWNTQVHTAGRALRRRDDLYRQVAAIFADQAGLVVVDDTDMGAVAASRSDAPTAVTDPAARRRTYAAPGVLRASIVAAAAREGVPVRSVSHKGMSVIHAECGTVNECDDRFLSALIKCEGCGKVYNQDVNALEVVMREGRRHTSVA

SEQ ID NO: 61 - protein, 696 aa, Unknown
  source: /note="Description of Unknown: aquatic-freshwater sequence"
MGSRVFQFGCPFGPSAGLDETIEQMRLGRAYYNARQEVSRQVRNQTRSIYASCGSVSDLERAVEEAKERKDALELEIKTARAETRTRWTKKSSAQDLKEARTVLKDARAELGAFRSRLREDPIVAAKLATITGGRPKRKDGEASRRHDNTVKNNGTKALAMRALRAEYGPRGKGLGSGTYLLVEAAQGVSEADTPLYDREGQPQDPGFRCWSMGSKHVAVHVQGFELTGATIFQPNDWAWIKPVDPRAWLKETPRGERKRLSRTMLHLRLKTGEDREPVWAVVPIIVHREIPLTAKVTWIVLSMCQQGPRAVWTCEITVNEEAPQSVPEGRGTAAVVFGWRNVSGGILAATWLNTDGVAGQLVLGDGDLDTTDADGGKGGIISGLTRVDSLKETRDKNLNAALASLVSWLRDHDMPEWMRLRTVKRQYDENHQEVQRVLPSKAQALAYLAGWKAQGKLAALCLAWRENRFSGDDDAFRALESWRYHDNHLWRWQAAQNESAHLRRRERYRIVGIELAKHARVLLDGTDFARIAFRPKTEDDKGYVQGPATNRTLVAPSELRDTVKQAAAKMLRDAVKVESANTAITCPRCGNVSKVQRFDDGDFKHSFCCVECGLTGDQDSIRCMNMLVADGHKDAVLEILRRQEEALRYQRRLSNGGDYGEDASNRSENAGVQGAAREVQCDRRRGVLLPHDVGG

SEQ ID NO: 62 - protein, 670 aa, Unknown
  source: /note="Description of Unknown: aquatic-freshwater sequence"
MVTKRLAYGLLEPTENLETVEDQMSKAHKYYNKLVEIENSIRPLRRESYNNGVKRLSPEYEGLEQQLLALQASKDTIENEIKQQRVLNRSKKLDSSNHKQTLAGIKLQIKLVYEKQKEERAKFKGKLKRPSKEKVEPEPHKRPSKEKVEPEPHKRPSKEKVEPEPQWLAEQEEIDEKRNKLISEARKASGLYWGTYLSTEDAFKNACKATPPHKNLHFQRWTGEGKIRVCRNSEPTVSNSLFFIDPLPGDSWEKKKDKGVPSPRGEGKRSRMKTQLHLLVNSNRQKKIAPVWATFPMMLSRPLPDNGRIDSVEVIRKRCGPNWKWAAQVTCTFEETNKPPKGKAIVALDLGWRKIDGNIRVAAFGAIDDAPISLPSESCPDLQQAVVKVGNGYELQLTPEVISGIRKSEELRSIRDSEFNDIRSILTRWLQENDVPEEIRTLKKRGKLNVMSQLQFIHWINSLRSQAQLASLIYRWKDNRFEGYEEILEALENWRYADQHLWEWESEQRRGAIARRNNLFKNFASWLRSIATMVVIEGDFKITDVAERKGLIEDTNRNEIAQSNRQLAGTSILRICIKNKLGNDCIGVPAKNTSKECHVCGEVVEFADPAALEQECHNHHQWDRDHNAWKVLLKRYASGDVIVKTLGTARKGKKKRNSKKLATGEQKIVG

SEQ ID NO: 63 - protein, 655 aa, Unknown
  source: /note="Description of Unknown: aquatic-freshwater sequence"
MGSRVFQFGCPFGPSAGLDETIEQMRLGRAYYNARQEVSRQVRNQTRSIYASCGSVSDLERAVEEAKERKDALELEIKTARAETRTRWTKKSSAQDLKEARTVLKDARAELGAFRSRLREDPIVAAKLATITGGRPKRKDGEASRRHDNTVKNNGTKALAMRALRAEYGPRGKGLGSGTYLLVEAAQGVSEADTPLYDREGQPQDPGFRCWSMGSKHVAVHVQGFELTGATIFQPNDWAWIKPVDPRAWLKETPRGERKRLSRTMLHLRLKTGEDREPVWAVVPIIVHREIPLTAKVTWIVLSMCQQGPRAVWTCEITVNEEAPQSVPEGRGTAAVVFGWRNVSGGILAATWLNTDGVAGQLVLGDGDLDTTDADGGKGGIISGLTRVDSLKETRDKNLNAALASLVSWLRDHDMPEWMRLRTVKRQYDENHQEVQRVLPSKAQALAYLAGWKAQGKLAALCLAWRENRFSGDDDAFRALESWRYHDNHLWRWQAAQNESAHLRRRERYRIVGIELAKHARVLLDGTDFARIAFRPKTEDDKGYVQGPATNRTLVAPSELRDTVKQAAAKMLRDAVKVESANTAITCPRCGNVSKVQRFDDGDFKHSFCCVECGLTGDQDSIRCMNMLVADGHKDAVLEILRRQEEALRYQPAAE

SEQ ID NO: 64 - protein, 601 aa, Unknown
  source: /note="Description of Unknown: aquatic-freshwater-anoxic lake water sequence"
MLDQLRLASVYRNKLVEIELARRAATDDTLRELCPGLLECEAELADVNAKIAEAIAEHKAKNAKARCLTDDKEIKAALTQLKCIRKELATTRKRLRDDGFSPLTEADLSLVPGLAEATKIHAAAENPHAKAKAAAVMHECRSSWLNDPSRPTPIRRLAIQIQLAEIGYAANEAQKTARKTSGLAPGSYLLVDQAADAFRKGAPPVFRGYQGEGRVGVQIVGGMNSEEANSGRDTRLRIVHTPQAEQRVAKNGRVLPAPGAKRQAQQYTLWLRIGSDGRTPTWATWPLILHRPIPETTRIMWAIVQRRIVGGHERWQLTLNLRDDTNAAFARRDVTASGVCGVDIGYRYIDDRAQRVAYWHGSDGASGELQLPSGKVAQWKKVDDLQSIRDGLHNEARAALRDWLATNAHPEWLDEATEHMHAWRRLSRLDRLVAQWRGQRFDGDAEIMATLESWRTRERHLWQYQEQMRDQLLAWRKDFYRNFAAMLRRRYRTIAVEDMDLRSAIHDVLRPEEERETVTAQRRAARFAALSVLVAAIKDSGADVVAVEQAGTTSTCSWCGASNEVGTGVIHTCVGCGREWDRDDNAARNICARGEVAVKTR

SEQ ID NO: 65 - protein, 620 aa, Unknown
  source: /note="Description of Unknown: aquatic-freshwater-anoxic lake water sequence"
MSSKNYTYGLQTPVGNRDRVLDQLRLASVYRNKLVEIELARRAATDDTLRELCPGLLECEAELADVNAKIAEAIAEHKAKNAKARCLTDDKEIKAALTQLKCIRKELATTRKRLRDDGFSPLTEADLSLVPGLAEATKIHAAAENPHAKAKAAAVMHECRSSWLNDPSRPTPIRRLAIQIQLAEIGYAANEAQKTARKTSGLAPGSYLLVDQAADAFRKGAPPVFRGYQGEGRVGVQIVGGMNSEEANSGRDTRLRIVHTPQAEQRVAKNGRVLPAPGAKRQAQQYTLWLRIGSDGRTPTWATWPLILHRPIPETTRIMWAIVQRRIVGGHERWQLTLNLRDDTNAAFARRDVTASGVCGVDIGYRYIDDRAQRVAYWHGSDGASGELQLPSGKVAQWKKVDDLQSIRDGLHNEARAALRDWLATNAHPEWLDEATEHMHAWRRLSRLDRLVAQWRGQRFDGDAEIMATLESWRTRERHLWQYQEQMRDQLLAWRKDFYRNFAAMLRRRYRTIAVEDMDLRSAIHDVLRPEEERETVTAQRRAARFAALSVLVAAIKDSGADVVAVEQAGTTSTCSWCGASNEVGTGVIHTCVGCGREWDRDDNAARNICARGEVAVKTR

SEQ ID NO: 66 - protein, 588 aa, Unknown
  source: /note="Description of Unknown: aquatic-freshwater-aquifer sequence"
MTRVFEYGLPFDPFDGAELVDEQILLAHRYYNKLIELEHTRRSSILAVQRADPKVGPLLAAYDAANAEVEDLLARKREAKSRDRRVAAPELSEIEAAKEARRHLSVQLRKVKKVATDRLKPEYDLAEQATRDAKKAARAASGVFWGTYSLIEQAADAAAKAKPVLRPGTHPRPWDQQPSFRRWTGEGMVAVQININRPLNDVTVFGDDLRLRITPVDPAAWSDATSRGDRKCLARTNVTMRVGRNTGETATWPMVMHRPLPAGSRVTWAKVLRWRLDDRPHWFKYVLQLTVETADAPRHPGLVSLPPAIVAINCGWRALPNGSLRVVTWVGSDGAEGVLDLGCREYRDRIERAESIRSVRDQLRNELTSKLVGIGIDVTRWRSFDRFHRLFRELTAEGCERNEAVELLEAWHHRDRHLRQYQDGARGGALRFRREQYRLLAVELARRYPVVCVESWDLRPVVTDEDRLPGPAAARVEGASSTARLALASAATREGCVVLTQIAAHVRLQTQTCHVCGYGAKKGEEWDAAAELVHTCEGCGETWNQDVNFCRNILAASRAAVTEIPELLVPKIMKRSARFAARHKKVAT

SEQ ID NO: 67 - protein, 685 aa, Unknown
  source: /note="Description of Unknown: aquatic-freshwater-bog sequence"
MLVYKWGIGPLPLEARQIIDREVRAAHRYRNRLVEIERSRRAAYRDLRNSLSPELAHLHAAYAAADRAVVEGRRLLSGVPRAERARHPVAAEVRRLSAARSGAWKAYAEARDRTTADVFGAADQKYREAKQSVTAAVGFACAVARFARGADPGPIGPHVLAAITAAVRERALADPAVGEPWKAKTRSQMEHEALAKRARAECGCAVGTYLAVEAAAEKSFAECAGDPPFSRLECERVGLQVRGGGLSADDVVGAAVGQVRVEFPADMTARANGTRYAVVHLHLSGRGDQATWLHLPVVWHRDMAPEARVRWAYVVARRVGLVWHYELQLTCDSVDRARAQSAGARGTIALNLGWRALKNGDLRVATPWSGSASRAEDRLVLPRSFREGSDLADRLLSYADEHFLAVRDALAGWFKGGERSLFSPEQVAAWSLDTVHAWRSHGRLARVALDLRRDWLEARGVDVPALWKAWRLERSPKLDLFGPLDEIKAWLAGRGVVSADQVLAVYLDWWRAKDRHLVNWARNNDLRLRRSRRDRYRCYARDLAARYERVVIEQWNKSETAETPDPEADTRTEQEVRGNSNRVLACVSELVDALEAAFGEANVHRAPSERITVEHHGCGGESSDPLPQIPVTCFACGQVYDQDLNAAKHLYDRHSGEPSGGVNVGGGARGAKKSRRVEGFGRAAE

SEQ ID NO: 68 - protein, 702 aa, Unknown
  source: /note="Description of Unknown: aquatic-freshwater-bog sequence"
MSENMPTLVYRYGIAAPHDNADLVYEQLRLAHEYRCSLVRIERTRRAEERAARLAVSAEVAAAEAAVAAADAECERLATEIRKARSDARKRVETQQMRDALAKAREVRKERKTALFELRDRYQPQCRDCRATKSEDKPCPHVGQEAQSFCLVLDAIAERAKESIRKARAESGLYWGSYLLVDRAMAASRKAPLYGDDGITPNDPKMPRFDGGGAVAIQFQSSSVRPSNVRLADLGPDNARLQIVLPPWPEQCMPAPESHQGPFDPSRPPAGMRPDGTLAPATRADGSPARWLRRRANRQALVRMCVKTEGRGKPVWAAWRLDYDRPLPAQAIISWATIHRRMRGPHAEWSLCLTVEVAAEPAAEIRSGQVAIDVGWRQMPCPGGAACHGQRTDCHELRVAAWRDHGGGSGELRLSARDIRALRQPAELRSKRDTQFDAIKAAVAGWIRSASDAPEWMREAAKVMHAWRWQGRMVALVRQWAQERPNRAAPEEAVYQAALAWQTADWALWESERARDAWAHRRRREIYRVWAARMAETYGTLILERFDLRDVTERAPVGQDDSENETARSNRHLAAVSELRGALCNAVRTRGSEVVGVTAVNSTRTCPSCGLVSDRNQAQAVQLACECGHVWDQDVEGAAPWLLAEYRERPGDAKLQAGARAEAIAAARKGKKGNDWARAKRMGAAKKGRLQAARESAATEAQ

SEQ ID NO: 69 - protein, 629 aa, Unknown
  source: /note="Description of Unknown: aquatic-freshwater-bog sequence"
MKLVYKYGLATPHDNRELVEEQMRAAHRYRNTLTEIERGRRAAVRQAEAEAGDMPKALQALRASEAELEAALTAIRRHRARTSKRDEPVALKASAKAAREAKRAASKAFRDLRRRIAEDPMVVAAKDAIGERANELGRSARAHSGVYWGSYLLVEAAASASFEDTPMYASDGRPTDPAFVRWTGEGEVGVQLQGGLGADEATACTDTQLQITQPDERAWERRGRTHRECEQMARQAQLRMRVQSDAKGKPVWATWRMDMHRPLPEGAIIKLATVHRVRVGPHSKWYVTITLDVPARARVSPSSGTVAVDVGWRVVGDELRVAGWQDTTGARGELRLSPRDIAMLRAPEAMRSERDRRFDAARANLLGWLRSHQELVPEWLAKATTTLHAWRSEARLVALYSRWSGSRFEGDEQPYYALASWRARARHEWAVESCARDQALRRRRERYRVWAAQLASKYNTIVIEKFDKREVAVIPAPDVQVEQNAEQAARDKAARSNRFLAATSELCDCLVTAARSRGCTVIAVPCEDTTRTCPVCGLVESRDAAAAIELTCECGASWDQDVDGAPAVLLARARERPGDTKILVGAREDEKKNENGQKPESQWQRVRRMRAEKEARMGTAREAAPEGAE

SEQ ID NO: 70 - protein, 560 aa, Unknown
  source: /note="Description of Unknown: aquatic-freshwater-bog sequence"
MTTRVYQFALLPPSGRDAALVDAQMRLAWEARQDMAMIERGRRSAMRALLDTPDVRAAEEALKAATRSTRKDVIRVVSRARRDALERAVASERYDDEACQETGYCPLYEPERIEQLAKLATKGAYHYFGDRGLAWGTRLDVSGAADAARKAPLYDDDGLTPSDPHVERWYDAKRPPDSQLAVQLQGGLSTPDGLTGQDTRVRLVDGVLWLRVGSDGRAPVWAKFAIARPHRTGKRGVRTTHRAIPDDAKWKWVRVSRRRDGPWMRWSVEITLDVEREDWRVRDPQVQGVLAVEVCWDRPDDAIVVARWRDDSGRSGTIELPDRIATGLPKVHGIRAVRDTIRADMAKRLQRALTEDRDPKPVWLADAAGSMHLWKSSSRFHRLIQQWQDERCDAARPAYELLDAWRLRDNHLYEYETGARGNVLRWRKNWYQTLAAEWARRYRIVVLDDRNLSREARWGEASEIRFMASPFELRQAIRNAFGRDVAEHTVKQTEKEKDEDDRDWCERALDARNAGVARTERETSEIKDKRGGAWAKRKQAKTTRHAEREAARKAVVKAAE

SEQ ID NO: 71 - protein, 618 aa, Unknown
  source: /note="Description of Unknown: aquatic-freshwater-bog sequence"
MAVYVYQFGLSAPFGENADLVYDQLFATHRYRNTLIEIERGRRAAVRAVIDASNAQTVALTAEVARWNAETEALAKRIKSQRASTRTRSESESDREALRQAREARKAAVTKLREARLAQRTDAAMTAAIDAINERANGLVRGARELTETYWGTYLLTEKAMQDSKALPLYGDDGISPNDPKFLRWEGDGALGVQIQGGAKAATILAEASTLLRMRPDARAYLERACDQRRIKDKTGLLTMRVGSDAKGGPIWATWHMHMHRLIPENAMIKGATVHLRKVGTKAEWSLEVTVEHSRAALPPNDKTIAIDIGWRMIGDELRVAGWMDSDGKTGELRLSAKDIRLLRRPEEIRGERDRHFTLAKTALGSFLASAAQVPDRLRAETAHLDRWGSADRLAAVVARWERFEGDAAIHNVMTAWFWRDRNLCDQEAGMRLQALRRRKNKYREWAAWVTETYGTVVVEKFDLRAVALRGAVEDPAANETARSNRQLAALSEARTAIVNAASSRGRLIAAMPAHDTTRACPSCGVVEAREAEASIVLVCPDCGATWDQDVTGAPVVLLGRWRERPGDAKILVSARDGANDNESETMRPNRWQKVKEARTAKVLRRESARAEASNGAE

SEQ ID NO: 72 - protein, 591 aa, Unknown
  source: /note="Description of Unknown: aquatic-freshwater-bog sequence"
MKELRGNHELRNRLVEIERERRKAVRALCADLPELAAAQVCRTALDEALQTIKKARSETKKRSESAEDVKRAKEARKAYQEALRALALARRARLSACEAEIKVVNDESAKREKEAYGESPVEAWGSKLDVFAAHAAVRAMPYWDELADNDPHFVRWEGEGQIAVQLQGGLRVGAALSGGDRRFQLTDLVPEAFEATDAAKNPRDRRRLRGAVGRLRIGSDARNPIWTEVRVQVHRPLPPSGIIKWARLSRRRVALAYAWSLEVTVDVPLSAVARPGVVGLDLGWRKKPDGSLRVGYLAFRETAKDAIATRTRELVLPASLVQRFARLREAESERTHAFEMERMWLSRLLSTFVELPDWLKKESETLSQWRSPARLARLARIWSENRFERDELPYERLRGWAAGDALRYQENEEARQSALRAREWYYGNWAAACANAYGALAVENMNISRLIRHRDPDADEPAHEERARSRAVAAPGRLRQVFAHAFEGRGGIVMLRPTKNTTITCPTCGDVRKFDAAEILAPTCANGHTIDQDERAARNLCEGVSGEEAAEAARAREVRESTPKESRWAKVKRMKREKEEGALARGVGSAG

SEQ ID NO: 73 - protein, 610 aa, Unknown
  source: /note="Description of Unknown: aquatic-freshwater-bog sequence"
MNRVYRYSCSPPKTEAERVMKELRGNHELRNRLVEIERERRKAVRALCADLPELAAAQVCRTALDEALQTIKKARSETKKRSESAEDVKRAKEARKAYQEALRALALARRARLSACEAEIKVVNDESAKREKEAYGESPVEAWGSKLDVFAAHAAVRAMPYWDELADNDPHFVRWEGEGQIAVQLQGGLRVGAALSGGDRRFQLTDLVPEAFEATDAAKNPRDRRRLRGAVGRLRIGSDARNPIWTEVRVQVHRPLPPSGIIKWARLSRRRVALAYAWSLEVTVDVPLSAVARPGVVGLDLGWRKKPDGSLRVGYLAFRETAKDAIATRTRELVLPASLVQRFARLREAESERTHAFEMERMWLSRLLSTFVELPDWLKKESETLSQWRSPARLARLARIWSENRFERDELPYERLRGWAAGDALRYQENEEARQSALRAREWYYGNWAAACANAYGALAVENMNISRLIRHRDPDADEPAHEERARSRAVAAPGRLRQVFAHAFEGRGGIVMLRPTKNTTITCPTCGDVRKFDAAEILAPTCANGHTIDQDERAARNLCEGVSGEEAAEAARAREVRESTPKESRWAKVKRMKREKEEGALARGVGSAG

SEQ ID NO: 74 - protein, 717 aa, Unknown
  source: /note="Description of Unknown: aquatic-freshwater-freshwater lake hypolimnion sequence"
MNPASMAPKGMIVGLLMTYNIYLPLLFCKFEACRIYLGVLAIGQARYTSEKLEAKKMLDKGAKVTFTYDGNETSGKILHILAAGKKPAAYFDILTAADKALEADRCFDETRSCEDESYLVVTKRSKNTVAKIYWLSKDDLSGVQVVVRQYGLLQPSNWQDDCFNHLYLQNRYWNCLVEIEQDNRNKYRALVGEDEDVAPIQDAIDGLKSRIADMAEQRTQLKIEHCKKIGIHTEPLDNAIKAAKAEMKKLSNKAKEARAVAKERIRAAGPAFKLLEDERRQSVKEAYNNSQLWWGNYNAITNSYNTARTRAMKEGADLRFHRFDGSGRFTCQIMGGMSTDDLLSGRNSVAQLRKVSNSEFTKIIKSNPPALQLQLVGSRRDEREYGVLSITIYTAEDDQGKKTRRTLDFPIILHRPLPENATLKIISVNRKKIGTDYRWAVTFTFSEETKESIVHTSKQTCGINLGWKQVAGGLRVATVSDGTSTRHVVLPQVIIDKLAYTESLQSRIDTATNENFIWLLGKMADPPEILKGDVTSLKRSKRPHPAKFAKFVIKWRNECSEFEPQALIEAEVMRKNVKRLSLEHHHLRDKVLRRRIDFYRNEAKKIADKYSMIVMDKMDLRQMSALEKSDGTPNELADLARYHRKVAAISEFREWIGKQAIKAGGAVEMIAIESTRTCNACDGVMAPSDGLMFRCKSCGTFVDQDENASANLLRAVT

SEQ ID NO: 75 - protein, 611 aa, Unknown
  source: /note="Description of Unknown: aquatic-freshwater-freshwater microbial mat sequence"
MSVRVYKYGLRRPHEQGERVRAQMRAAHRYRNTLVEIERARRTAVRSAMSAYGNIGELEAAARSADVVVSDAVRLAKAAKAEARSHSGVSSDQKAALLAARERKRDAVRLLRETRVLLRQDVVLSTEVDRVNELAAELRRNARKHCGVYWGTYLLIEAADEAARKVPLYDGAEPSDPRFMRWAGEGRVGVSIAKGADIAVLDDTKDTRIRIEPGTMPKGADPASKRSAKRRHAVLAMRVGSGDQREPVFARWEMVMHRSLPAGARIKNAAVSLRLVGPREEWSVAITLDTTACAETATRGRGVVGVDLGWRMLNGDIRSAAWDGGDVSGFLALPAELIGQVEKVADLRSIRSKNFDASRAALVAAMPADAPAWLRGATASLGQWKSIDRLTKLALRWRVARFDGDAAAYDALEAWRYNDHHLWCWESEQRTRTLRHRREIYRIFAAKLAREYETLAIENFDLRVFSVRAPVETDASIDTVTRAARVVVSPSELRLSLVNAFGPHRVVKVDAANTTRECSECHHINTWDAAAELSHTCAQCGARWDQDANAARVIRARGTAASPAPGAARNGDSANDSAAPIESRWAKAKRMRAEKRSGEGGARKPVDAAAE

SEQ ID NO: 76 - protein, 588 aa, Unknown
  source: /note="Description of Unknown: aquatic-freshwater-freshwater microbial mat sequence"
MRAAHRYRNTLVEIERARRTAVRSAMSAYGNIGELEAAARSADVVVSDAVRLAKAAKAEARSHSGVSSDQKAALLAARERKRDAVRLLRETRVLLRQDVVLSTEVDRVNELAAELRRNARKHCGVYWGTYLLIEAADEAARKVPLYDGAEPSDPRFMRWAGEGRVGVSIAKGADIAVLDDTKDTRIRIEPGTMPKGADPASKRSAKRRHAVLAMRVGSGDQREPVFARWEMVMHRSLPAGARIKNAAVSLRLVGPREEWSVAITLDTTACAETATRGRGVVGVDLGWRMLNGDIRSAAWDGGDVSGFLALPAELIGQVEKVADLRSIRSKNFDASRAALVAAMPADAPAWLRGATASLGQWKSIDRLTKLALRWRVARFDGDAAAYDALEAWRYNDHHLWCWESEQRTRTLRHRREIYRIFAAKLAREYETLAIENFDLRVFSVRAPVETDASIDTVTRAARVVVSPSELRLSLVNAFGPHRVVKVDAANTTRECSECHHINTWDAAAELSHTCAQCGARWDQDANAARVIRARGTAASPAPGAARNGDSANDSAAPIESRWAKAKRMRAEKRSGEGGARKPVDAAAE

SEQ ID NO: 77 - protein, 603 aa, Unknown
  source: /note="Description of Unknown: aquatic-freshwater-freshwater microbial mat sequence"
MSIRVYKYGLRRPHEQSERVRAQMLAAHRYRNTLVEIERARRAAVRSAMSAYGNIGELEAAAHAADTVVLGVVRLAKAAKAEARSHSGISSDQKAALSAAREHRRDAVRLLRETRVLLRQDVVLSTEVDRVSELACELRKSARKHCGVYWGTYLLIEAADEAARKAPLYDGAEPSDPRFARWIGEGRVGVSIMKGADISVLDMEDTRIRIEPGTMPKGADPTSKRSAKRRHTVLAMRVGSDDQRGPIFARWEMVMHRPLPAGARIKNAAVSLRLVGPREEWSVAITLDTTACAETATSGRGVVGVDLGWRMLDGDIRSAAWDGGDLSGYLALPAELIGQVEKVADLRSIRSKSFDASRDALIAVMPTNAPAWLRAATSSLRQWKSINRLTKLALRWRVARFDGDAAAYDALEAWRYNDHHLWCWESEQRTRTLRHRREIYRIFAAKLARKYETLAIENFDLRVFSVRAPVETDASIDTITRAVRVVVSPSELRRSLINAFGPHRVVKVDAANTTRECAECHHINTWDAAAELSHTCAQCSARWDQDANAARIIRARGAAASPQGRNSDSATTTESRWAKAKRMRAEKRSGEGGDRKSVDTAAE

SEQ ID NO: 78 - protein, 555 aa, Unknown
  source: /note="Description of Unknown: aquatic-freshwater-freshwater microbial mat sequence"
MSAYGNIGELEAAAHAADTVVLGVVRLAKAAKAEARSHSGISSDQKAALSAAREHRRDAVRLLRETRVLLRQDVVLSTEVDRVSELACELRKSARKHCGVYWGTYLLIEAADEAARKAPLYDGAEPSDPRFARWIGEGRVGVSIMKGADISVLDMEDTRIRIEPGTMPKGADPTSKRSAKRRHTVLAMRVGSDDQRGPIFARWEMVMHRPLPAGARIKNAAVSLRLVGPREEWSVAITLDTTACAETATSGRGVVGVDLGWRMLDGDIRSAAWDGGDLSGYLALPAELIGQVEKVADLRSIRSKSFDASRDALIAVMPTNAPAWLRAATSSLRQWKSINRLTKLALRWRVARFDGDAAAYDALEAWRYNDHHLWCWESEQRTRTLRHRREIYRIFAAKLARKYETLAIENFDLRVFSVRAPVETDASIDTITRAVRVVVSPSELRRSLINAFGPHRVVKVDAANTTRECAECHHINTWDAAAELSHTCAQCSARWDQDANAARIIRARGAAASPQGRNSDSATTTESRWAKAKRMRAEKRSGEGGDRKSVDTAAE

SEQ ID NO: 79 - protein, 571 aa, Unknown
  source: /note="Description of Unknown: aquatic-freshwater-freshwater microbial mat sequence"
MSSRSKENRMFGHESKPTRNYVYGILAPTEGADLVDEQLRAAHQYRNNLVRLELDRREAVQQCLLAMRPAVARLTGEVADAVTAYDAAAAALKVRNARERNKRASADERQASKDAAALLKGLRGQLKAVRTEAFAADDVRAALDAIETVASERRREARGACGVYWGTYLTVEQAAGSFRSGAPPIFHRWTGEGRLAIQLQNGVEPAVLTLGQDKRLRIELTGECGRGKRPLAVAWLRVGSDGRAPVWAKFPMVYHRPIPVDAKIKWAFVHRRRCGTFWRWQLMLSVARDAWESPTTSGGSVGIDLGWRVVPEGLRVASWAGDDGRRGELILPADDLRRWSEPATRRAERDVRFGEFLPRVADWFAANAGRFGEEMRERVKTIRQWRSPARLAGLLRAWSAERVTGDEEIYGELVRWMREDSREWNSESGQRARASRWRDDYYRCFVKRLASEYRVVHVEDMDLREIKRKPKAEEAESENQTARGNAFIASPGRLRELIREGFAETMSIDAAWTTQRCHACGEIDGFDAAAELVRTCRHCGVAEDQDYRAAMNLLHGEQPDADEMAVVARGV

SEQ ID NO: 80 - protein, 562 aa, Unknown
  source: /note="Description of Unknown: aquatic-freshwater-freshwater microbial mat sequence"
MFGHESKPTRNYVYGILAPTEGADLVDEQLRAAHQYRNNLVRLELDRREAVQQCLLAMRPAVARLTGEVADAVTAYDAAAAALKVRNARERNKRASADERQASKDAAALLKGLRGQLKAVRTEAFAADDVRAALDAIETVASERRREARGACGVYWGTYLTVEQAAGSFRSGAPPIFHRWTGEGRLAIQLQNGVEPAVLTLGQDKRLRIELTGECGRGKRPLAVAWLRVGSDGRAPVWAKFPMVYHRPIPVDAKIKWAFVHRRRCGTFWRWQLMLSVARDAWESPTTSGGSVGIDLGWRVVPEGLRVASWAGDDGRRGELILPADDLRRWSEPATRRAERDVRFGEFLPRVADWFAANAGRFGEEMRERVKTIRQWRSPARLAGLLRAWSAERVTGDEEIYGELVRWMREDSREWNSESGQRARASRWRDDYYRCFVKRLASEYRVVHVEDMDLREIKRKPKAEEAESENQTARGNAFIASPGRLRELIREGFAETMSIDAAWTTQRCHACGEIDGFDAAAELVRTCRHCGVAEDQDYRAAMNLLHGEQPDADEMAVVARGV

SEQ ID NO: 81 - protein, 561 aa, Unknown
  source: /note="Description of Unknown: aquatic-freshwater-freshwater microbial mat sequence"
MTSVYRYGLLPPTLGADVVDDQMRAGHRYQNALVELERARRDAVAGVLSNNAIDEIDLEIKALDEELSARRAAIQAERGATKRKRVPHTTATRDIARRRELRGTRRTLIAARRADPAVMAALAGIEERAKVLHKQFRADSGVYWCTYLKVEQAMDAARKGAKFGPPSFRRWNGGGAVSMQLQRRGPERLLMTADNAIECDDPRLHLDLIPTPVPNRRGKPLPRVRLRVGSDGARRPIWAEWPMIYHRPLPDGAVITWATVIRELVASSPRWALLLTIEHGGVAPTAARGAAVAVDLGWRRAIVDGDITTRACGHTATDDSDESELHVHRDVFGALGKADNLRSIRDKRMNEMQAILVAWLRGCGSEEHRERTRFVAQWRACARFAGLAIWWRDHRIEGDELIFVLLEAWRKRDKHLWLWEAHARRTARARRLDGYRVFAADLARRYETLIVEKINLAKVAEKPKPESTREHNATASSQRTATAPSELRGALVNAFRGRGGTVVEVGAHPSATAMLGEWRERPVAEEKPGVARMSKFGRLRAERGGSWAQRSRPLEGGSASD

SEQ ID NO: 82 - protein, 570 aa, Unknown
  source: /note="Description of Unknown: aquatic-freshwater-freshwater microbial mat sequence"
MTSVYRYGLLPPTLGADVVDDQMRAGHRYQNALVELERARRDAVAWVLSDGVIDEIDRGIEALSEELSAQRAGIQAERGATKRKRVPHTAETRGLDDRRRELRGTRRTLIAARRADPAVMAALAGIEERAKVLSKLLSKSSGVHWGTKGVVHQAMDAARKGAKFGPPSFRRWNGGGAVSMQLQRTGREKRPLTADDAIECDDTRLHLDLTPTPVPNRRGKPRRGKPLPRVRLRVGSDGARRPIWAEWPMIYHRPLPDGAVITWATVIRELVASSPRWALLLTIEHGGVAPTAARGAAVAVDLGWRRAIVDGDITTRACGHTATDDSDESELHVHRDVFGALGKADNLRSIRDKRMNEMQAILVAWLRGCGSEEHRERTRFVAQWRACARFAGLAIWWRDHRMEGDELIFVLLEAWRKRDKHLWLWEAHARRTARARRLDGYRVFAADLARRYETLIVEKINLAKVAEKPKPESTREHNATASWQRTATAPSELRGALVNAFRGRGGTVVEVGAHPSATAMLGEWRERPVAEEKPGVARMSKFGRLRAERGGSWAQRSRPPEPLEGGSASD

SEQ ID NO: 83 - protein, 565 aa, Unknown
  source: /note="Description of Unknown: aquatic-freshwater-freshwater microbial mat sequence"
MFGHESKPTRNYVYGILAPTEGADLVDEQLRAAHQYRNNLVRLELDRREAVQQCLLAMRPAVARLTGEVADAVTAYDAAAAALKVRNARERNKRASADERQASKDAADLLKGLRGQLKAVRTEAFAADDVRAALDAIETVFRERRREARGASDVYWGTYLTVEQAAWSFRSGAPPIFHRWTGEGRLAIQLQNGVEPAVLTLGQDKRLRIELTGEYGRGKRGKRPLAVAWFRVGSDGHTPVWAKFPMVYHRPIPVDAKIKWAFVHRRRCGTFWRWQLMLSVARDAWESPITSGGSVGIDLGWRVVPEGLRVASWAGDDGRRGELILPADDLRRWSEPATRRAERDVRFGEFLPRVADWFAANSGRFSEAMRERVKSIRQWKSPARLAGLLRAWGDERVVGDEEIHAELVTWMREDSREWNSEAGQRARASRWRDDYYRCFVKRLAIEYRVVHVEDMDLREIKRKPKAEEAESENQTARGNAFIASPGRLRELIREGFAETMSIDAAWTTQRCHACGEIDGFDAAAELVRTCRHCGVTEDQDYRAAMNLLAGEQPDADEMAGVARGV

SEQ ID NO: 84 - protein, 574 aa, Unknown
  source: /note="Description of Unknown: aquatic-freshwater-freshwater microbial mat sequence"
MSSRSKENRMFGHESKPTRNYVYGILAPTEGADLVDEQLRAAHQYRNNLVRLELDRREAVQQCLLAMRPAVARLTGEVADAVTAYDAAAAALKVRNARERNKRASADERQASKDAADLLKGLRGQLKAVRTEAFAADDVRAALDAIETVFRERRREARGASDVYWGTYLTVEQAAWSFRSGAPPIFHRWTGEGRLAIQLQNGVEPAVLTLGQDKRLRIELTGEYGRGKRGKRPLAVAWFRVGSDGHTPVWAKFPMVYHRPIPVDAKIKWAFVHRRRCGTFWRWQLMLSVARDAWESPITSGGSVGIDLGWRVVPEGLRVASWAGDDGRRGELILPADDLRRWSEPATRRAERDVRFGEFLPRVADWFAANSGRFSEAMRERVKSIRQWKSPARLAGLLRAWGDERVVGDEEIHAELVTWMREDSREWNSEAGQRARASRWRDDYYRCFVKRLAIEYRVVHVEDMDLREIKRKPKAEEAESENQTARGNAFIASPGRLRELIREGFAETMSIDAAWTTQRCHACGEIDGFDAAAELVRTCRHCGVTEDQDYRAAMNLLAGEQPDADEMAGVARGV

SEQ ID NO: 85 - protein, 571 aa, Unknown
  source: /note="Description of Unknown: aquatic-freshwater-freshwater microbial mat sequence"
MSSRSKENRMFGHESKPTRNYVYGILAPTEGADLVDEQLRAAHQYRNNLVRLELDRREAVQQCLLAMRPAVARLTGEVADAVTAYDAAAAALKVRNARERNKRASADERQASKDAAALLKGLRGQLKTVRTEAFAADDVRAALDAIETVASERRREARGACGVYWGTYLTVEQAAGSFRSGAPPIFHRWTGEGRLAIQLQNGVEPAVLTLGQDKRLRIELTGECGRGKRPLAVAWLRVGSDGRAPVWAKFPMVYHRPIPVDAKIKWAFVHRRRCGTFWRWQLMLSVARDAWESPTTSGGSVGIDLGWRVVPEGLRVASWAGDDGRRGELILPADDLRRWSEPATRRAERDVRFGEFLPRVADWFAANAGRFGEEMRERVKTIRQWRSPARLAGLLRAWSAERVTGDEEIYGELVRWMREDSREWNSESGQRARASRWRDDYYRCFVKRLASEYRVVHVEDMDLREIKRKPKAEEAESENQTARGNAFIASPGRLRELIREGFAETMSIDAAWTTQRCHACGEIDGFDAAAELVRTCRHCGVTEDQDYRAAMNLLHGEQPDADEMAGVARGV

SEQ ID NO: 86 - protein, 562 aa, Unknown
  source: /note="Description of Unknown: aquatic-freshwater-freshwater microbial mat sequence"
MFGHESKPTRNYVYGILAPTEGADLVDEQLRAAHQYRNNLVRLELDRREAVQQCLLAMRPAVARLTGEVADAVTAYDAAAAALKVRNARERNKRASADERQASKDAAALLKGLRGQLKTVRTEAFAADDVRAALDAIETVASERRREARGACGVYWGTYLTVEQAAGSFRSGAPPIFHRWTGEGRLAIQLQNGVEPAVLTLGQDKRLRIELTGECGRGKRPLAVAWLRVGSDGRAPVWAKFPMVYHRPIPVDAKIKWAFVHRRRCGTFWRWQLMLSVARDAWESPTTSGGSVGIDLGWRVVPEGLRVASWAGDDGRRGELILPADDLRRWSEPATRRAERDVRFGEFLPRVADWFAANAGRFGEEMRERVKTIRQWRSPARLAGLLRAWSAERVTGDEEIYGELVRWMREDSREWNSESGQRARASRWRDDYYRCFVKRLASEYRVVHVEDMDLREIKRKPKAEEAESENQTARGNAFIASPGRLRELIREGFAETMSIDAAWTTQRCHACGEIDGFDAAAELVRTCRHCGVTEDQDYRAAMNLLHGEQPDADEMAGVARGV

SEQ ID NO: 87 - protein, 611 aa, Unknown
  source: /note="Description of Unknown: aquatic-freshwater-freshwater microbial mat sequence"
MSVRVYRYGLRRPHEQGERVRAQMRAAHRYRNTLVEIERARRTAVRSAMSAYGNIGELEAAARSADVVVSDAVRLAKAAKAEARSHSGVSSDQKAALSAARERKRDAVRLLRETRVLLRQDVVLSTEVDRVNELAAELRRNARKHCGVYWGTYLLIEAADEAARKVPLYDGAEPSDPRFMRWAGEGRVGVSIAKGADIAVLDDTKDTRIRIEPGTMPKGADPASKRSAKRRHAVLAMRVGSGDQREPVFARWEMVMHRSLPAGARIKNAAVSLRLVGPREEWSVAITLDTTACAETATRGRGVVGVDLGWRMLNGDIRSAAWDGGDVSGFLALPAELIGQVEKVADLRSIRSKNFDASRAALVAAMPADAPAWLRGATASLGQWKSIDRLTKLALRWRVARFDGDAAAYDALEAWRYNDHHLWCWESEQRTRTLRHRREIYRIFAAKLAREYETLAIENFDLRVFSVRAPVETDASIDTVTRAARVVVSPSELRLSLVNAFGPHRVVKVDAANTTRECSECHHINTWDAAAELSHTCAQCGARWDQDANAARVIRARGTAASPAPGAARNGDSANDSAAPIESRWAKAKRMRAEKRSGEGGARKPVDAAAE

SEQ ID NO: 88 - protein, 588 aa, Unknown
  source: /note="Description of Unknown: aquatic-freshwater-freshwater microbial mat sequence"
MRAAHRYRNTLVEIERARRTAVRSAMSAYGNIGELEAAARSADVVVSDAVRLAKAAKAEARSHSGVSSDQKAALSAARERKRDAVRLLRETRVLLRQDVVLSTEVDRVNELAAELRRNARKHCGVYWGTYLLIEAADEAARKVPLYDGAEPSDPRFMRWAGEGRVGVSIAKGADIAVLDDTKDTRIRIEPGTMPKGADPASKRSAKRRHAVLAMRVGSGDQREPVFARWEMVMHRSLPAGARIKNAAVSLRLVGPREEWSVAITLDTTACAETATRGRGVVGVDLGWRMLNGDIRSAAWDGGDVSGFLALPAELIGQVEKVADLRSIRSKNFDASRAALVAAMPADAPAWLRGATASLGQWKSIDRLTKLALRWRVARFDGDAAAYDALEAWRYNDHHLWCWESEQRTRTLRHRREIYRIFAAKLAREYETLAIENFDLRVFSVRAPVETDASIDTVTRAARVVVSPSELRLSLVNAFGPHRVVKVDAANTTRECSECHHINTWDAAAELSHTCAQCGARWDQDANAARVIRARGTAASPAPGAARNGDSANDSAAPIESRWAKAKRMRAEKRSGEGGARKPVDAAAE

SEQ ID NO: 89 - protein, 593 aa, Unknown
  source: /note="Description of Unknown: aquatic-freshwater-freshwater sediment sequence"
MIRVYKYGIKPPFDFGEDCVDELRRMNNYWNRLVEIDREREVAFRNLCRSWSPEYATAMDRIDALKQPIDAIYEEIRATRVKNRNKELPDEIKVRKDRLLGERKVLWETCKAIQKKLPKDLQEPLIQKYKTDCKLARQQSGLYWGNYNAVSESFETAKSRTIKEGGRLHFRLFDGAGRFVNQIQGGMTAVDLFTGAKSQAKCSASVIRKSRGGTPHHSFTFTAFTGRDVDGKRFRRELTADLAYHRPIPAEGTIKSIEIVRDIIDGHEKWHVCFTVSLPDIEIEHPKRNIAGVNMGWRQIGSALRIAVIVDDKNQKREYFLPATVAHKFEHAESIQAKADEAENEMLVWLREIYQAANQAPQEWKEAVQGVLRNRPARDAYAKLLSEWEGAQDLINGFDEYKAWHKENKKLHRYYAGTRRRAIAWREEIYRSIAKEIAENYAVIAITDTPLSQMSRTKSSGGLSIDNALPPAARRNRVIAGIYTLKEWIDKQAAKTGAVVEKITDKVTQTCHKCSAIADKRVGSERYITCTNCESELEVDENAAINSRKLASGEVTPKKELRKAAKYQRVREAMNAKNDSARKMADNSSDGVA

SEQ ID NO: 90 - protein, 535 aa, Unknown
  source: /note="Description of Unknown: aquatic-freshwater-glacier valley sequence"
MNNSTPTNPSERSEPLAALERVRVVQFGACAPTAGWEAGFLQHRLRTRFWNAICEIERNHRDTVQAIVGPLKEAGMPSKDAYASEDVQALELARKGKRLVARQEAAQGGLFWTGYLEVERAMDTARRGLEPPRFKRFEAHEGKLNFLFTNGLASSELCGDDLRVQFEPLELPEGCSARTRKANPYHVKLRVCSQDKKPVWLEFVAYLHRPIPEGSVRDVALIWRREGAKQRYSLSVTVREGGVIHAPAPFERAAINIGWKRLTHGLRVAYWRGTDGKHGEIVLSNAWLERYHHALGIESVRAKPLNSIKEQMLAYFRTTPDVPEEMATRVTHLAQWRSAARFAVLYKFWVGQRWHGDDAGFNALEAWHKRDVHLWQYGEGTSARLMRSRREQYRTFAAKMLERYGEIVMDKLDLRIFAELEARGDDLAPIARAQRVQAAPSTLRLALQNAYGREGRVVSWVGARTSSTCHVCRAPVVLGRDLIHTCQGCQSHWDVDDNACSNLLREPEAGIKIPKASRSPRARKNLALGTAVGAD

SEQ ID NO: 91 - protein, 599 aa, Unknown
  source: /note="Description of Unknown: aquatic-freshwater-groundwater sequence"
MKRSKSDKSARVYKFGSPLKTAVESEVAMEQLRLQNRFWNALVEADKVFTEKYWAIRDGADARLPVLRKQIEDIKVRTEEIRTEIKKGRQDGIKGTPSDLKAEIVELKAQKKPLIAEKKEIWAFVKDTVKPQLHELDGERYDKNVAIRQEYAQNGLYWGNYLAVMDSFETARMAIMKTQVEDGQKRPELQFHRFERVGRWTCQIQGGMNITQAFLGSNNYFQIDRLPADAWTHPSRGERGRLKRTKARIRIGSGEKKTVPIWLEIPIVMHRPIPESAEIKSVSIHVSKLADKFVWSLTVTVREDCSVPLERTGHCVAINIGWRAKGLATRIAYMLDSRGVEEEILLGSEYTVSNEKAASLQGIRKKNFNETVAWFNEWKKANADIVPPWLSERTKMMMSWKSEAQLASVAIQWSGRGFRREGDPPEFRFHGDEEAFNKIEAWRKQDKHLWQWHANLSDRIRGRRLCEYRKIALKLSKEYDVVIQEDFDLRKTKGKKKAEEGADNDDHIRRMSDLASVSTFRTETIRAMRSAGKEHVKLDSKNITKTCPFCGGTIKPGRKTNIMVQCSKCGKVYDQDWAASKNLLTAYLDSSGDVPPETP

SEQ ID NO: 92 - protein, 588 aa, Unknown
  source: /note="Description of Unknown: aquatic-freshwater-groundwater sequence"
MTRVFEYGLPFDPFDGAELVDEQILLAHRYYNKLIELEHTRRSSILAVQRADPKVGPLLAAYDAANAEVEDLLARKREAKSRDRRVAAPELSEIEAAKEARRHLSVQLRKVKKVATDRLKPEYDLAEQATRDAKKAARAASGVFWGTYSLIEQAADAAAKAKPVLRPGTHPRPWDQQPSFRRWTGEGMVAVQININRPLNDVTVFGDDLRLRITPVDPAAWSDATSRGDRKCLARTNVTMRVGRNTGETATWPMVMHRPLPAGSRVTWAKVLRRRLDDRPHWFKYVLQLTVETADAPRHPGLVSLPPAIVAINCGWRALPNGSLRVVTWVGSDGAEGVLDLGCREYRDRIERAESIRSVRDQLRNELTSKLVGIGIDVTRWRSFDRFHRLFRELTAEGCERNEAVELLEAWHHRDRHLRQYQDGARGGALRFRREQYRLLAVELARRYPVVCVESWDLRPVVTDEDRLPGPAAARVEGASSTARLALASAATREGCVVLTQIAAHVRLQTQTCHVCGYGAKKGEEWDAAAELVHTCEGCGETWNQDVNFCRNILAASRAAVTEIPELLVPKIMKRSARFAARHKKVAT

SEQ ID NO: 93 - protein, 623 aa, Unknown
  source: /note="Description of Unknown: aquatic-freshwater-groundwater sequence"
MRVYRYGLLRPTDEQELGLVREQMRLANKYRNWLVWLERGYRMALSELVDAHPSVAPFLSETEASEVKVDAKEVKIRRKRKATRSRSESTEDRQEVATERVSLTERRNALSAARWAALKGPLKAEAKRMNDLWEEMQKETRRQSVCGVFWGTSQIQDLAMKESRKALLWYRGKLALPDFVRWSDNQSVGVQVQDNIPPEDLFRQGSLVRIAPVSPQAWSEAVPRGDRKRLQRTVLSLRVQSDAKRQPVWAHWPMIMHRAIPAGCVVTRVAVRCRMIGPREEWYATITVDDSKAETAQPCGNGTVAMDLGWRAMKGGGIRVARWRDSDGGSGEFQLDEHIVSSLRKAEGLHATRDDNFNEARAKLQKWLAGAPDVPGWLRLDTETLGSWRSLERLQALAGKWKKNRFAGDEEGYAALEQWHYHDYHLWQWESDQRAKSLRHRRELYRIFAAKMACRYSTLVLEDFEIPGVAKKPTVEEDSEYNKNAAHNRQLASPHEFRECMKAAFVARDGMVQLLPCADTTRHCSVCGSLELFDQAKHLWHTCLACEGEGRATTWDQDDNAAQNLLDLWQNGADPVKTVSKALALANKREPAWIKAKRLARAKREADASGAVVQQPTEALEAE

SEQ ID NO: 94 - protein, 612 aa, Unknown
  source: /note="Description of Unknown: aquatic-freshwater-groundwater sequence"
MGLVSGIKVYRYGLLAPTENAHLVGEQMWLAHRYQNTLIEIERARRAALRAVYVAHGDVAAMTAVCQAATAEVARLYRDAKAARSQSRKRQIPSEIGDALKVAKEASREAQARLRAARLAIKTDPSVVASREQIEERAAWLRRNARAYCGVYWGTYLGIESAVSQTAKMPLYDGSEPNDPRFSRWEHEGTVGVQLQGGLAGAGAMRCDDTRLRIEVGTAPKGVDPTSRRSATRRYMVLAMRVDSDGRDPVWARWPMKMHRPLPDDAVIKWAHVHRRRRGPHDEWSVTLTIETSAARPAAPTGAVGIDLGWRSLDTDGIRVAAWHGSDGRSGTLVLSEWDLSRLEKANDLRSIRDKKFDAARAALSTWLENACVPAWFHEATAHLVQWKSIERLMGLVRRWKGSRFGGDDAAYEALEAWRYNDHHLWAWEAHQRVRALRNRREIYRVFAARMAREYHTVVLEDWNISKIAKRPAVDEETVADGNKNSRTARQSVAVSELRLALTHAFGARVEKVPCAFTTRDCHACGSVESWDQAAELVHTCSSCGVVWDQDANAAQNLLARFAARGGGDLDNAGTARGNETMNASETLKESRWARAKRVKAERIASDQVARE

SEQ ID NO: 95 - protein, 627 aa, Unknown
  source: /note="Description of Unknown: aquatic-freshwater-groundwater sequence"
MIPDGKRKGEKRMILIYEYGIPFDPMEGHDFVEDQILMAHRYYNKLIEIERAKRARIRAIQQAHPILGPLVTESDETHELFNDIIDRQKKAKSKDNRYPEVDPEEWEAAKEISAEVRLRLTAAKAAVKAELTPAYEAASQEAKDRKRLARANSKVYWGTYLITEAAAEAAVNAKPKSRPGKVPPPWHMCPAFRRWNGEGSLAVQIQKPKALTEVTVFGHDNQFRITPVDPYAWDKSTPRGLRCRLGRTTFTMRVGMKRGETASFRMVMHRPLPPGSRITWAKIIRRRVDDRLYRFRYFLQLTVETTLCVRHPGLDNADPVSIPVVAINCGWRALADGSLRVATWLGSDNRTGTLELGREEFRDRIERAESIRSRRDIDLDELKKAIEGFGEIFKSMEVECVEKWKSFSRFHGLYCDVLTEYAENPTEEKKELLELLTSWHHRDRYLMQYENGCRGGALRFRREKYRLFALELAKAYPVVCIESWDLRRIVEDEHRLKEPSAARVEGASSIARQITRNTSLREGCVVLKQGDKEVELATQRCHLCGYGAKKRERWDAAKELVHVCGGCGAEWNQDVNFCENILTTSRGDLVGAPQLLEPKIVIQLGRFQKRAAAKREREAAQADEQEE

SEQ ID NO: 96 - protein, 658 aa, Unknown
  source: /note="Description of Unknown: aquatic-freshwater-groundwater sequence"
MIPDETTTSLFAGKLSDPGRNSHRHCSPGNLVIPDGKRKGEKRMILIYEYGIPFDPMEGHDFVEDQILMAHRYYNKLIEIERAKRARIRAIQQAHPILGPLVTESDETHELFNDIIDRQKKAKSKDNRYPEVDPEEWEAAKEISAEVRLRLTAAKAAVKAELTPAYEAASQEAKDRKRLARANSKVYWGTYLITEAAAEAAVNAKPKSRPGKVPPPWHMCPAFRRWNGEGSLAVQIQKPKALTEVTVFGHDNQFRITPVDPYAWDKSTPRGLRCRLGRTTFTMRVGMKRGETASFRMVMHRPLPPGSRITWAKIIRRRVDDRLYRFRYFLQLTVETTLCVRHPGLDNADPVSIPVVAINCGWRALADGSLRVATWLGSDNRTGTLELGREEFRDRIERAESIRSRRDIDLDELKKAIEGFGEIFKSMEVECVEKWKSFSRFHGLYCDVLTEYAENPTEEKKELLELLTSWHHRDRYLMQYENGCRGGALRFRREKYRLFALELAKAYPVVCIESWDLRRIVEDEHRLKEPSAARVEGASSIARQITRNTSLREGCVVLKQGDKEVELATQRCHLCGYGAKKRERWDAAKELVHVCGGCGAEWNQDVNFCENILTTSRGDLVGAPQLLEPKIVIQLGRFQKRAAAKREREAAQADEQEE

SEQ ID NO: 97 - protein, 560 aa, Unknown
  source: /note="Description of Unknown: aquatic-freshwater-groundwater sequence"
MFGHESQPSRIYAYGAKAPVVNGERVGEQIWLGHRYRNTLAEIELRRREQTDKMVVTLSPELPGVEAKLLEADQAIESAAAEIKLANKQARRQKATPEQKTKLAALRKERAALRKKRKALRDVVFSDSGTHDALTGIDQRAAAEQREARAESGLYWGTYLTVEQGCQSFRKGRPPRFLRWTGEGRIAVQVQGGLAPEDAFGGEDKRLIVEPLPEDAWSKRSRGLKRTKAWLRIGSDDDRQPVWAVVPFVMHRSLPADCRIKWVYLHRRRVGTKDQWMLSFVIARQVWPQTDVAGSGEIGIDLGWRLLDHGLRVAAWAGSDGESGELVLPIQDVGRWQKAQDLRGIRDTRLDAVIARFGEWLSGNDAPDWLTERTRTLRQWRSAARLASVVLAWRDQRFAGDESIYADLEAWRKKDKHLYEWEANQRRKAVAWLKDLYRNFAAAMARRYRVAVLEAVNWRDMGRRAGVGESDKAGAARRQRVIASPGRLAECIRERFADCVSAPAEYTTQRCHACGEIDGFDARVEIVHTCGKCGKTWDQDYNAARNLLAFASGPVAKKTR

SEQ ID NO: 98 - protein, 561 aa, Unknown
  source: /note="Description of Unknown: aquatic-freshwater-groundwater sequence"
MMFGHESQPSRIYAYGAKAPVVNGERVGEQIWLGHRYRNTLAEIELRRREQTDKMVVTLSPELPGVEAKLLEADQAIESAAAEIKLANKQARRQKATPEQKTKLAALRKERAALRKKRKALRDVVFSDSGTHDALTGIDQRAAAEQREARAESGLYWGTYLTVEQGCQSFRKGRPPRFLRWTGEGRIAVQVQGGLAPEDAFGGEDKRLIVEPLPEDAWSKRSRGLKRTKAWLRIGSDDDRQPVWAVVPFVMHRSLPADCRIKWVYLHRRRVGTKDQWMLSFVIARQVWPQTDVAGSGEIGIDLGWRLLDHGLRVAAWAGSDGESGELVLPIQDVGRWQKAQDLRGIRDTRLDAVIARFGEWLSGNDAPDWLTERTRTLRQWRSAARLASVVLAWRDQRFAGDESIYADLEAWRKKDKHLYEWEANQRRKAVAWLKDLYRNFAAAMARRYRVAVLEAVNWRDMGRRAGVGESDKAGAARRQRVIASPGRLAECIRERFADCVSAPAEYTTQRCHACGEIDGFDARVEIVHTCGKCGKTWDQDYNAARNLLAFASGPVAKKTR

SEQ ID NO: 99 - protein, 589 aa, Unknown
  source: /note="Description of Unknown: aquatic-freshwater-groundwater sequence"
MQAKVYVYGLRPPTHEAERVAEQLHLAHRYRNDLVAIERKRRERVAALLSASGLSAHEERLEAAEQVLEAALSSLRAVRQAACKRAETSEQREAVKAARADVKAFREQLKEERKQLRPTLSAETETINDGAADERRAARAVCGVYWGTYLLIEQADEQARKSPTPPQFQRWTGEGAVGVQLQGGLDTDTVFGADTRLQIDPVPPTAWDRRRSPERRTRVRLRVGSDGRAPIWAEWPVTLHRPLPTGEIVWAKVLRQRVEAKSEWGLHLTIRVEDPTPTARSGAVGVDLGWRLREDGLRSGYWVGSDGEHGEILVDQRTLDRLQKVKSLCSIRDRNLDELRPWLAEWLRARRAGLPEWLRERTQYLHTWKAPRKFNALSVAWRAQRFPGDGEAVERLEAWRKQDKHLWTWETHQRERTLRCRREGYRLLAATLAERYGVLVLEDLDLRVFQQRRPAEAEQGECQPARSQQPVAATSILRSCLINAFEAVGGRVVKLDPAGTTKECWLCGGTAWSVQAEESVDRTCRECAALVDQDENAGRVLLARFERSGGIAGSADPDTSKSGQLRVSGGRWQRRKERCSKSGTQDCTA

SEQ ID NO: 100 - protein, 606 aa, Unknown
  source: /note="Description of Unknown: aquatic-freshwater-peatland sequence"
MKRKTSLVPTKVYRYGLLSPTSNGRLVDETIYRGHQFYNRLIEIERARRAEYRAERTRRFPELATVESLVEDLTKQIETMRTAIVATKIATQSRAVATDSAAELKRLRDERKIAHDRLVEMRAACKSDLDFSAWVKIANEKAYGLVKAARNSCGVAWGTYNLIAASAQQASATSTMDPEFRRYDGEGRIGVQIIGGMSVADLATDTQLQIAMPEFHDGMTRGEWRRASRTVVKMRVGSDENRRPIWAEFPAVIHRPLPEDARIMSAVITRRRLGVFRRWEYSLCISCESNKFDRTLPGLKQEGTATINFGWRQFSDGFRVATVNNDVTGIEEIRLPKTITDRFSKCEDLRSIIDMRFNIVRAELQEWLASHKADCPEWLTTSLEFLHLWKQPERLDRVVGNWAGLRFAADADIYSILADWRTKYRHLQDWQMMNRRQGLNMRKEFYRLVASRLAQHNAKLVVEAFDVRQVAVLPRPEEVASGGTAARHNRFLVAVGNLRSSILLAAQKYHCAVDVVKATNNTRRCNVCGKLLDWDPAKTVNRECPECSTWDQDVNATDNAVDRVASGEVVTMIAPAELAENGSIRPATKRSWGAARNELDKMPSLL

SEQ ID NO: 101 - protein, 623 aa, Unknown
  source: /note="Description of Unknown: aquatic-freshwater-peatland sequence"
MSAILVYKFGLLRPVDNATMVHQQVRAAHDYRNDLTMIERGRRAAIRSVLESEPDVAAALTGARAARALLDAALAVVASARASARTRAAGAPATGDVKSVRAVLHAAEGTFRQALQAVRTRSHVVSETDRINERAGELGRSARAHCGVYWGTYLLIEADMQASRKMPLYDGVEPNDPRYQRWTGKGRLGVQIQKGMSASAVFGADTRIRIDPVNERAWPATSTLGWSERRRLQHTTLHLRVSSDGAAPIWAAWPMSMHRPFPEGARIKGAVVNLRRVAGREEWTVCITLDVTDTQRAQCCGEGAVAVDLGWRLLCQPQAHNETGLRVGTWRGEDGAAGTMTLSHHWSGGELKARELRSIRDKAFEAARDALAVWLASPGDRPAWLAAKTRALGQWRSAHRLAAVAQWWAAHRFDGDAQAFAALETWRYHDHHLWQWETHQRETTLRDRREQYRIFAAGLARRYRTLVLEAFDLRKLARLPAPEQVDGEAQAPRSQRQLVAPSELRDALVKAFVARGGEVVEVSAVDSTRICHACGVVELWDQAAELRHTCSACGVEWDQDDNAGANLLTRYRERPSGDETPGPARKAEKTGKEGSKWARAKALRAERDTRTGAARKALAKCAE

SEQ ID NO: 102 - protein, 619 aa, Unknown
  source: /note="Description of Unknown: aquatic-freshwater-peatland sequence"
MEDVDLQYRMRYSCHNDLVAVELERRYTFRAYRSTLPEYAVVEQPYLELKKQRDAVREEIKLIRQKSRTRVETPEQNARVAALNAELKKQDVFLKIAAKKVSGDLGLVAVGKEADEVAKAATKAILDDYAARGLTWGTRALVVQELQAAKNAERDPKIHPWDNSGRIGLQLQGKNLSEEMVASGKHIASEQKRLRAMTKELGKKSKVVESFAERLLKMKQDRYAQKTPENRGLPISGLADDTRLQIVVPPEIAYQAASTRRGDRRRAARTTMKMRIGSTPKNAPIWMECKVTMHRQLPADGIIKWAWIRKKMLGTHEIYHLQLIIEAPSFEQKIAVADRMEAIAVDVGWRVREKNVLRIAYLVDTAGNRKEILLPTSIVEKLKHADSLRGKEDDAFNAIQDRLMEWIGLNKPILPAWFQDTFQFLAQSRSSKNLAWNVREWGRRRFAGDTLIYEEMTAWRRQFLHLYEWETNERAKAMGERKNFFRHVGLDLARSAHNVLLEDFKLAKIVENAQPEEDDDNPQTQRHNRVMSAISEFRQAIASACSAWRSTLWKLPAAYTTQDCHACHQEKDKHSKWDAAPAIVHTCQEKCGKTWDQDYNASMNLLGAWLRSRRTNRAA

SEQ ID NO: 103 - protein, 642 aa, Unknown
  source: /note="Description of Unknown: aquatic-freshwater-peatland sequence"
MVRKSTEDPTRIWSFRITEITSPMEDVDLQYRMRYSCHNDLVAVELERRYTFRAYRSTLPEYAVVEQPYLELKKQRDAVREEIKLIRQKSRTRVETPEQNARVAALNAELKKQDVFLKIAAKKVSGDLGLVAVGKEADEVAKAATKAILDDYAARGLTWGTRALVVQELQAAKNAERDPKIHPWDNSGRIGLQLQGKNLSEEMVASGKHIASEQKRLRAMTKELGKKSKVVESFAERLLKMKQDRYAQKTPENRGLPISGLADDTRLQIVVPPEIAYQAASTRRGDRRRAARTTMKMRIGSTPKNAPIWMECKVTMHRQLPADGIIKWAWIRKKMLGTHEIYHLQLIIEAPSFEQKIAVADRMEAIAVDVGWRVREKNVLRIAYLVDTAGNRKEILLPTSIVEKLKHADSLRGKEDDAFNAIQDRLMEWIGLNKPILPAWFQDTFQFLAQSRSSKNLAWNVREWGRRRFAGDTLIYEEMTAWRRQFLHLYEWETNERAKAMGERKNFFRHVGLDLARSAHNVLLEDFKLAKIVENAQPEEDDDNPQTQRHNRVMSAISEFRQAIASACSAWRSTLWKLPAAYTTQDCHACHQEKDKHSKWDAAPAIVHTCQEKCGKTWDQDYNASMNLLGAWLRSRRTNRAA

SEQ ID NO: 104 - protein, 623 aa, Unknown
  source: /note="Description of Unknown: aquatic-freshwater-peatland sequence"
MSAILVYKFGLLRPVDNATMVHQQVRAAHDYRNDLTMIERGRRAAIRSVLESEPDVAAALTGARAARALLDAALAVVASARASARTRAAGAPATGDVKSVRAVLHAAEGTFRQALQAVRTRSHVVSETDRINERAGELGRSARAHCGVYWGTYLLIEADMQASRKMPLYDGVEPNDPRYQRWTGKGRLGVQIQKGMSASAVFGADTRIRIDPVNERAWPATSTLGWSERRRLQHTTLHLRVSSDGAAPIWAAWPMSMHRPFPEGARIKGAVVNLRRVAGREEWTVCITLDVTDTQRAQCCGEGAVAVDLGWRLLCQPQAHNETELRVGTWRGEDGAAGTMTLSHHWSGGELKARELRSIRDKAFEAARDALAVWLASPGDRPAWLAAKTRALGQWRSAHRLAAVAQWWAAHRFDGDAQAFAALETWRYHDHHLWQWETHQRETTLRDRREQYRIFAAGLARRYRTLVLEAFDLRKLARLPAPEQVDGEAQAPRSQRQLVAPSELRDALVKAFVARGGEVVEVSAVDSTRICHACGVVELWDQAAELRHTCSACGVEWDQDDNAGANLLTRYRERLGGDETPGPARKAEKTGKEGSKWARAKALRAERDTRTGAARKALAKCAE

SEQ ID NO: 105 - protein, 556 aa, Unknown
  source: /note="Description of Unknown: aquatic-freshwater-polar desert sand sequence"
MSTLVYAYGCAPNTPICEEVDEQLHLAHEFYNKLVELEIRHENALDAMWREYPDIASMMDQIDTTDLIITELKKRGKAERVENVSTVTSEPLALELKRAKRGQKETRAALRTAKNRIKEDVALPKKHLLAEHQARAKAARIDFAHRGLYWGTYNRVWADMKVAVEGVIRKRTGGEPARLHFRRWDGTGTLAVQLQRQDGDPPRDPQGLAEGTTKWRNVFSVAPWMPPAEFDSMTRPAQLRIAEQGRVRMNVGASRVVKIPVLVHRMLPPDADVLGASLTVTRVAGRRRASVSVIVNLPDAAPVGDDGPRVSVTLGWSSVPHGIQVAKLSADRPLRIPADIADLVHRGPDPHTTEITVPAAWCNRLDSAMGLQSRRDTALDAIRSELVEYLRAHPDTSDRPITTTEVARWKAPARFAAVALRWRNNPPLPHGKMIAATLEAWRRTDRRRWEAETHTRRRALGCRRDGYRRVAAWLARECSEVTMSSTDLSKLAHRTEVGASASNAVPEEVAQLARQQRVLVAPSELRESIVAACRREGVSVASGAVRAPVSENARSA

SEQ ID NO: 106 - protein, 582 aa, Unknown
  source: /note="Description of Unknown: aquatic-freshwater-polar desert sand sequence"
MKSTLNWCYGAKTPDIEQAVSDAIFAAHTYRNQLCALELEKRARHYQVLVELSPDYVAACDAVTLVEVAAQAVEDLITAEKVTQRTQTPKNIKHLRDRATALAAELQVKRAVRKVAQCSAYAMPAVIAALDRSTAQHKAARKQAKQASGLYWGTEATVTESCRDFHKGPPPTFKRYDGTGQLSVQLQGGLDCADAERYNTLCYLGDSLGGKRRECFIRIGSDNRAPVFACVPIVFHRALPAGEIKRAYLERRKIASHVRWTIRFTIDIERDIPDRPMPGEVAIHTGWRMEEGSLRVATWLASDGSTGTLRLSQEHCADYLRLDSLEANRAAGLNEVIAELRTWAKSRELPEFLTEVKPHLHLWKSQARLAKLVWHWAEARFDGDSAMFERLDSWRKTDKHLWQHHRRLTVRISRRRRDAYRVFAKSLSERYGVAILAPIQVQKLTKKPTETRPPEDWELDQTQSRRHAAWAAVSDLTSCIRERFPLRCITVSSVNMTKECVNCGEINKADGRKIQCRGCGQTYDCDDNAVANTLARGDAALLDGALLALVTEQELKEAAKQAKLVKLQEANNAARTTRQTDL

SEQ ID NO: 107 - protein, 547 aa, Unknown
  source: /note="Description of Unknown: aquatic-freshwater-sediment sequence"
MFGHTSDPSLIFRYGALPPVEDGPVLEQMRAAHRYRNKLVEIERDRREKAAAIVSAASPDLAGLERQYAELGEQVESAAAEIKATNQRARKQRATLEQRAKLRTLRAERAEVYARLKEAKHTAYHSLAARAALDQLDAVTLDATKAARATCSVYWGTYLQIEAGLGSIRKGPPPRFLRWTGDGKLAVQIQGGMSRQEAEVGDSRLKIATLERRGKATNVYLRIGTDEMRNPIWAIVPVIFHRPIPDDAQIKWVYLLARRVGTHTRWAVCFVLSRATGWGKPDLATDGAVGLDLGWRILDHGLRVAYWCGSDGAGEEIVLPLRDVSRWQKADDLRAIRGKNFDAARDELALWLAGRDLPDWLIEQTRALRQWRNATRLAALAIHWREDRFTGDEEAFAPLEAWRTQDKHLLEWEANQRRKAVAWRDDFYRRVAADLSRRYKTLVIEDCNWREMGRLPEVGESNESGRAGSYRVIAAVGSLARVLRERFAETVSADPAYTTQRCHVCGQLAQAETRTSVWVKCNHCGEAWDQDRNAALNLLSAASGAVT

SEQ ID NO: 108 - protein, 538 aa, Unknown
  source: /note="Description of Unknown: aquatic-freshwater-sediment sequence"
MIFRYGALPPVEDGPVLEQMRAAHRYRNKLVEIERDRREKAAAIVSAASPDLAGLERQYAELGEQVESAAAEIKATNQRARKQRATLEQRAKLRTLRAERAEVYARLKEAKHTAYHSLAARAALDQLDAVTLDATKAARATCSVYWGTYLQIEAGLGSIRKGPPPRFLRWTGDGKLAVQIQGGMSRQEAEVGDSRLKIATLERRGKATNVYLRIGTDEMRNPIWAIVPVIFHRPIPDDAQIKWVYLLARRVGTHTRWAVCFVLSRATGWGKPDLATDGAVGLDLGWRILDHGLRVAYWCGSDGAGEEIVLPLRDVSRWQKADDLRAIRGKNFDAARDELALWLAGRDLPDWLIEQTRALRQWRNATRLAALAIHWREDRFTGDEEAFAPLEAWRTQDKHLLEWEANQRRKAVAWRDDFYRRVAADLSRRYKTLVIEDCNWREMGRLPEVGESNESGRAGSYRVIAAVGSLARVLRERFAETVSADPAYTTQRCHVCGQLAQAETRTSVWVKCNHCGEAWDQDRNAALNLLSAASGAVT

SEQ ID NO: 109 - protein, 610 aa, Unknown
  source: /note="Description of Unknown: aquatic-freshwater-sediment sequence"
MAICKVYRYGLLPPTENRDLVLKTLRLAHEYRNKLVEIDRQERAEIRAVQTSHGSIPALAAAAKSAIQAKETAYQAIKAHKAQDRTRKVPEPLKATYEAAKAAASAASQALWQARAALRGDPTVAIRRDEISLRYNEKRKAARAASGIYHGTYMRVEAADQQARKMTPLWDGVEPSDVKFARWRGDGGVGLQMKEKPGPADLPTSRWCRIEPRGAPKGADPSSKRSAKRRHCTLALRVGSEEREPVWARWPMVMHRPLPEDGEILWVTVTLRHVGPRQEWVALFTVRHEDKRQVPPAEPVDRVGVDIGWRKLEGGGVRVAAWRTDSGAEGELVLDEHMLGQLRKADDLRSIRDKNLDAARASLVAAMPGMSLPDWFPKNVWQWRAPARFSNLAKRWKQNRFPGDDLPYAQLEAWRYHDHHLWAWETSQRTKALRHRLDVYRVFAARMARTYTGLVIEDWDMRDTAEKPDAHEQEGDNEQARSNRVKSAVSELRRALVQAFVNVAKVPAAYTTQTCSACGAIEKWDQAAELEHTCSACGAQWDQDYNAARNLLAYVEQPGGPDNGGVARDEKKPNDGAEVQESKWAKAKRMGKEKRDRVDTARNTVPSAAE

SEQ ID NO: 110 - protein, 543 aa, Unknown
  source: /note="Description of Unknown: aquatic-freshwater-sediment sequence"
MSGEEFLLDQLRARVDYWNRLVEIERDFQAEKEQLLSAASAEMEQLATYIALTDGKLTEALSAGARARSQARTRRTPEPLAAEIAELRDRLRELRKQYREVRRTTFGNEKVKAALRTLGSERTAVIRKARREHVLKGLWWGNYLDVELAYKTARQKAGSRLRFQRTGPEGRVSVWFQHGLPTSDVWGKDSRLTIARVPEEAWTSDVRSVRRRLARTRVWLRAGSNPDRSPRLIEAEMVMHRPLPHGLIRHASIIRERIASHYRHRLVITVAVQDIPTRDGREVGIDIGWRLFEDRLRVAVAVDEENQLEELSLPQEMLGGFAQVRDLQAVRDTHFNGAKAMLAAFLHTAQMPDWLRDATSTLTQWRSQGRLTALALQWRDRRFKDDAVYAMLEAWRKRDKHLWEWQANLRDKLLARRREMYRLWAISIARRYGTVVIEEFDLRRIVSEDNIDVADRMRFIAALSQLRSILEHTCAREGVRIVKVPASYTTQDCAFCANREQFDARKEVRHRCSKCGAEWDQDENAARNLLKRAKGSQVSRKEV

SEQ ID NO: 111 - protein, 593 aa, Unknown
  source: /note="Description of Unknown: aquatic-freshwater-sediment sequence"
MAVEAQFRAAQWYRNRLIEITNKSREKYQQLMLRIPEIARLQETIDADKALKESLREEIKVASAKARKNVPLRPGLREQIASLTKAIKENALTLRAAKDKAKAQIAEETNALYAETAAEQKALYNEAGQPGEIVHRKEGHPDIREPRVPLAWGTRLLMNKAHEQACSTGMPLKVRHDPVGRIGVQLQKGRTISQIFSGKDGFLRIEPVPDDTWDPRPQNAPKKGERLTREQHKARKGTGGKTKSRTRVHLNIGEGRGEDRPFATFPITLYNRKLPVDGKVLWAWILRERIGTRMEYKLQLSVESNTFKCESDGHGAIAFDIGWRVRSKNNLRIAYWFDDYGQSGEILLPEIIPSGLAKADSLQAIRKRKFNRMRALLSKAKADAIKTGMAIPPALLTETETLSAWRSEDRLRRLVKHIWPNHRFAGDERWFNIAKNWLHKELHLYQWECDERQQAIARRTNFYRHTALEFARKYQTCVFENFKLTRIAVKEPVESEKADTPSNIQHNRVVSALSDFRDAFKNKMIFAKVPMEFTTIVCHNCRHPEKFNAAKELIRTCPKCNTTWDQDLNAAKNILSRFHCEGTSGTDMGVQAA

SEQ ID NO: 112 - protein, 543 aa, Unknown
  source: /note="Description of Unknown: aquatic-freshwater-sediment sequence"
MSGEEFLLDQLRARVDYWNRLVEIERDFQAEKEQLLSAASAEMEQLATYIALTDGKLTEALSAGARARSQARTRRTPEPLAAEIAELRDRLRELRKQYREVRRTTFGNEKVKAALRTLGSERTAVIRKARREHVLKGLWWGNYLDVELAYKTARQKAGSRLRFQRTGPEGRVSVWFQHGLPTSDVWGKDSRLTIARVPEEAWTSDVRSVRRRLARTRVWLRAGSNPDRSPRLIEAEMVMHRPLPHGLIRHASIIRERIASHYRHRLVITVAVQDIPTRDGREVGIDIGWRLFEDRLRVAVAVDEENRLEELSLPQEMLGGFAQVRDLQAVRDTHFNGAKAMLAAFLHTAQMPDWLRDATSTLTQWRSQGRLTALALQWRDRRFKDDAVYAMLEAWRKRDKHLWEWQANLRDKLLARRREMYRLWAISIARRYGTVVIEEFDLRRIVSEDNIDVADRMRFIAALSQLRSILEHTCAREGVRIVKVPASYTTQDCAFCANREQFDARKEVRHRCSKCGAEWDQDENAARNLLKRAKGSQVSRKEV

SEQ ID NO: 113 - protein, 610 aa, Unknown
  source: /note="Description of Unknown: aquatic-freshwater-sediment sequence"
MAICKVYRYGLLPPTENRDLVLKTLRLAHEYRNKLVEIDRQERAEIRAVQTSHGSIPALAAAAKSAIQAKETAYQAIKAHKAQDRTRKVPEPLKATYEAAKAAASAASQALWQARAALRGDPTVAIRRDEISLRYNEKRKAARAASGIYHGTYMRVEAADQQARKMTPLWDGVEPSDVKFARWRGDGGVGLQMKEKPGPADLPTSRWCRIEPRGAPKGADPSSKRSAKRRHCTLALRVGSEEREPVWARWPMVMHRPLPEDGEILWVTVTLRHVGPRQEWVALFTVRHEDKRQVPPAEPVDRVGVDIGWRKLEGGGVRVAAWRTDSGAEGELVLDEHTLGQLRKADDLRSIRDKNLEAARAALVAAMPGMSLPNWFPKNVWQWRAQARFSNLAKRWKQNRFPGDDLPYAQLEAWRYHDHHLWAWETSQRTKALRHRLDVYRVFAARMARTYTGLVIEDWDMRDTAEKPDAHEQEGDNEQARSNRVKSAVSELRRALVQAFVNVAKVPAAYTTQTCSACGAIEKWDQAAELEHTCSACGAQWDQDYNAARNLLAYVEQPGGPDNGGVARDEKKPNDGAEVQESKWAKAKRMGKEKRDRVDTARNTVPSAAE

SEQ ID NO: 114 - protein, 547 aa, Unknown
  source: /note="Description of Unknown: aquatic-freshwater-sediment sequence"
MFGHTSDPSLIFRYGALPPVEDGPVLEQMRAAHRYRNKLVEIERDRREKAAAIVSAASPDLAGLERQYAELGEQVESAAAEIKATNQRARKQRATLEQRAKLRTLRAERAEVYARLKEAKHTVYHSLAARAALDQLDAVTLDATKAARATCSVYWGTYLQIEAGLGSIRKGPPPRFLRWTGDGKLAVQIQGGMSRQEAEVGDSRLKIATLERRGKATNVYLRIGTDEMRNPIWAIVPVIFHRPIPDDAQIKWVYLLARRVGTHTRWAVCFVLSRATGWGKPDLATDGAVGLDLGWRILDHGLRVAYWCGSDGAGEEIVLPLRDVSRWQKADDLRAIRGKNFDAARDELALWLAGRDLPDWLIEQTRALRQWRNATRLAALAIHWREDRFTGDEEAFAPLEAWRTQDKHLLEWEANQRRKAVAWRDDFYRRVAADLSRRYKTLVIEDCNWREMGRLPEVGESNESGRAGSYRVIAAVGSLARVLRERFAETVSADPAYTTQRCHVCGQLAQAETRTSVWVKCNHCGEAWDQDRNAALNLLSAASGAVT

SEQ ID NO: 115 - protein, 566 aa, Unknown
  source: /note="Description of Unknown: aquatic-freshwater-sediment sequence"
MPRTRSKALPTKVYKYGCSAPLENQELVKEQWRLANRYRNALLENSLQWRSACQAVVSAEDTELRDIDTCIDILNVNIDSLISEKKKRNSAARKRLKHPDLEAKITDCKTERKRLYARRKLVKDIAYRSPGNKQALDAVHQAFKAANREARKIASKSGLGWGTYLQIEDSAKNFAKGKPAKFKRFDRDAGGSIAIQIQTPQGAPHLTVDRLLEGKDNRLQLIPQPDGIHALVRLCVGGVDMSQRRSANNPPCYVTVRMNMHRPLPPDSHITWVKLIARRVGLKLKWDVHFTVARGSGFAPTIGSGVVGIDIGYRHLDDGSLRVAAWAGSDGRHGELILPATLVRALTRKQELQALRDEKFNVVRASLVEWCKHVSIPDWLKEAASTLALWRSQKRLHTLAQQWSQNRFTGDSSMYIVLDAWRKEDRHHLAWLANESEQGICRRKDIYGKFVAELRRHYGTVGLEDIDLREHAQADNLSKGVQNQRSIAAHSTLRSLLSTMQVIKVPAANTTRRCHYCGHINNVGTDVGYYCDDCGWTGDRDYNASQNILREATYSLRAGGRSHVAT

SEQ ID NO: 116 - protein, 620 aa, Unknown
  source: /note="Description of Unknown: aquatic-marine sequence"
MPVKSKMKGDGRIYAYRASLPTKNLEIVQEQLYLVHKYRNRLVELELNRRSQVDQALRDLVPDLEPTELALKQLDDQIAAAKDAQKKANIKQRGRKVAKSDRDALKDLKAQRKVLYQKRKQLRKDTFSSTAWKSRQTQIENNAKVESKAARASCGLYWGSYAPVEEAARAFRRGAPPRFHRWTGEGKLAVQMQAQAGKPDFTPDTLTSCSSNLLRLELRPEGIWVDGKRRPKKLGNALLWFRVGSTTVKPKRQPIWAEVPIKLHRPLPSDCKIKWCYLQRRKRGTKTIWEVCFVLQGEHGAFDPGDQASEGHVGIDVGWRKYEDRLRIAVYSGSDGQEGELCLPDWWLGESRRVERIRGHRDKLLDAAKTELKAWIKGRESLPDWLTEAGKHMHQWRSASRLAGLCLRWRGELIKPTTDGAAALASLEAWRERDKHLYEYEAHLRAQLQGSRKDLYRKFAAMLSRKYATAYIEDLDLRKFHQLRAIEEGGDKGTDSIRAYVRDACLSELFDAIKSRFRHHVKVDPANTTKQCHACSVVDASWVDHAKVDHECSSCSVTWDQDTNAARNLLNSGDEPVTQFGGPALAPVLVHTYTHKGPNRARRRARRRRALEKKRLNDAA

SEQ ID NO: 117 - protein, 479 aa, Unknown
  source: /note="Description of Unknown: aquatic-marine-aqueous sequence"
MRVYKYRAYAPIVGAGIFDAQSRARHRYQNQLIEIERAWCGLDRATKKDPEAQARRKALVKAARQDAARRGLAWGSYNGASDDVRRAVSALRGAARDEGPRFRRFDGGGRIKVQQQPGARVVVIDGDRVTFRLGHQGAVTVPVVMHRPIPPDATIKEAQLHRERVADKYKWWVTITVAVPAPPPAPPRGVVGIDLGWARRGGKSERDGRRVAVASFADGRELQVRCPESILAKIDHARGLRSLRDVKFNVAIAWLREHVCEHGAPEWLRAALRWSHAWRSQAKLAAVVLRWRDARYDGDDGIYQTLEIWRRRDKHLWTWEVHETRKALAQRREIYRVAAAYIAEHAGEVRVEDIDLAEMAESDDLPRAARRGRVDTAPSTFLAAVKNACSSRGVTYAVVSAKNTTRKCSGCGVVGRSVVGDTFACGGCGLVADRDANAARNIAASAPEAPREPKPKSADLRRAGKARHDAARAAAVKAA

SEQ ID NO: 118 - protein, 481 aa, Unknown
  source: /note="Description of Unknown: aquatic-marine-aqueous sequence"
MDVRVYKYRAYAPIVGAGIFDAQSRARHRYQNQLIEIERAWCGLDRATKKDPEAQARRKALVKAARQDAARRGLAWGSYNGASDDVRRAVSALRGAARDEGPRFRRFDGGGRIKVQQQPGARVVVIDGDRVTFRLGHQGAVTVPVVMHRPIPPDATIKEAQLHRERVADKYKWWVTITVAVPAPPPAPPRGVVGIDLGWARRGGKSERDGRRVAVASFADGRELQVRCPESILAKIDHARGLRSLRDVKFNVAIAWLREHVCEHGAPEWLRAALRWSHAWRSQAKLAAVVLRWRDARYDGDDGIYQTLEIWRRRDKHLWTWEVHETRKALAQRREIYRVAAAYIAEHAGEVRVEDIDLAEMAESDDLPRAARRGRVDTAPSTFLAAVKNACSSRGVTYAVVSAKNTTRKCSGCGVVGRSVVGDTFACGGCGLVADRDANAARNIAASAPEAPREPKPKSADLRRAGKARHDAARAAAVKAA

SEQ ID NO: 119 - protein, 664 aa, Unknown
  source: /note="Description of Unknown: aquatic-marine-deep subsurface sequence"
MGGKAGTVKTAKKHKHRWVEDLEKDLIENCSCGKSRKSQNSSVIVYGLGKPMFDEEGSECPSCNEESNGEPCGAHRFIDQMRLGHSYGNKLTELYRASSERYREIIGSASKKMEVIVMKLDDLDDQIKGLNALLKADKDNKEAKKLKKELTADRKIIRADRKELVEKLKQNKIIQARLKKNNIKLNSEIIKARGEFSKLGLMWGTYNLHEASAKQAQYAPGRRGDPEFKRWEGHGRIGVQLQGGLPESKVWGDSRSFQIDKVDHETWSKLREDGSPDRAFRRKQCRTKVRVRIGSAKAKPIWVEFPMTMHRPIPEGADIRDVTILQKKSGTIYRYSLHVQINENKTNQPERSGVVGVNLGWRKHQDNTLRVAYWYGDDGRYGEYLLDSEYLEKVKVMDGKQSKRSMALDVIKETFAVWLDGQDNLPEWIQEWRGIKFIRDWRSSSRLASLVLRWRKNRFDGDALIFENLEEWRRADKHTCNQEGGIRNKNQLRRQDEYRNFAAFLARTYGKVVVDDTNYANLARKPGPEDDDNKVARKQANLASPGKLRVNIKNACHKHGAIYVAASSKHITATCHKCGTINDWDKSLSLTHWCSGCNAFWDQDMNAAINLCRSGGGKPPNFEHPGDARIELNDEVNKYDWLIQESAGMAGSKKQPIENLAVTL

SEQ ID NO: 120 - protein, 572 aa, Unknown
  source: /note="Description of Unknown: aquatic-marine-diffuse hydrothermal flow volcanic vent sequence"
MRERARNWPVMVFSYGILPSFLKEEAAINILKEEAYRMNELWNKLVEIGRKYLETYSSNIEEDPAIAPLISQRKEIENTLEETDKQIKQLRIKLKTKKHPALAELEEKKRELRRQLREIKASIRETKKQVKEKYREVFAQMEEEVKEAVKKAPLYWCNKEVVRDKFWAAWRGVKNGNIPKFHRFDDRWCLTWRFTGGGMPVKDAFRKVLSGIVPPEVYKLPTKKRNKMANLTCLFRQGEYRILVPIILHRPLPEGGYIKRVTFVRRPYGRDRVRLFLNFTVEVPPDKYYLPVREERKGKIAALELGFRKVDGRIRVGVLYDPFTEEKFREIFIPQNIPERLEKVRKGQSKADEELEDIKNDLSKWLVEPQVLPKLPEEIKKLITNRVAWVKTRDRGVWKVINLLKESGADPAAARNVERRMLKREKFLNDLQRTRIKALGARKRFYENLAKEIFDRYEMLIIKDISLKKLALKEMAEQLPDEARWVRFVAALGELVGCLERRAERTKGVLVKLDPAYLTRTCHICNHINNPNRPEKLFWTCEKCGTKWDQDKNAAVNLYEQGIERLKLAQTG

SEQ ID NO: 121 - protein, 551 aa, Unknown
  source: /note="Description of Unknown: aquatic-marine-freshwater to marine saline gradient sequence"
MRLGHRYQNDLIAIERGRRLAFAAVMSSDTRIAEAEAKITEIDAKISEAVERARQARVARRTKADTEQTKSEIRSLKASKAAAVLDLRAIKPLVQSELRPRIAEVDARAHELQISARAHCGVYWGTYLLAEAAAEQAAKTTKGELRFQRWDGSGQVSVQIQGGADVDDVVGDSDTRLRWPEYVEGTRKAKRTELAMRVSSEKGVPVWARWPMVYHRPLPTNARIKRAIVSLRMRGPREEWSVEVTIDASTCRLRDRPDGGKVAVHLGWRKEPSGNVRVATWLGDDGDAGTIECPERVLTGFAKCESLRSIRDRNLDELRARLVLAREGWPVWLRDATSSLYQWRSPGRFVALAQRWKAAGVAPEHASDYGAIEAWRYNDHHLWRWEHDQRLNSTRYRREVYRIAVAELSRRYRRAILMAADWAEMAKLPGIGEGAPDLPDEARAQRVETAPYVLTEALHSAMTEVVWVDPSYLSQACRHCDHKDTGDTWVRECTSCGKARDIDEAAVRTMLDLEEAGAWSWKKGGAKDESGKVREIRAPKWAKKHATEAAE

SEQ ID NO: 122 - protein, 574 aa, Unknown
  source: /note="Description of Unknown: aquatic-marine-freshwater to marine saline gradient sequence"
MTTRVYRYGLLAPTENSELVRQQMRLGHRYQNDLIAIERGRRLAFAAVMSSDTRIAEAEAKITEIDAKISEAVERARQARVARRTKADTEQTKSEIRSLKASKAAAVLDLRAIKPLVQSELRPRIAEVDARAHELQISARAHCGVYWGTYLLAEAAAEQAAKTTKGELRFQRWDGSGQVSVQIQGGADVDDVVGDSDTRLRWPEYVEGTRKAKRTELAMRVSSEKGVPVWARWPMVYHRPLPTNARIKRAIVSLRMRGPREEWSVEVTIDASTCRLRDRPDGGKVAVHLGWRKEPSGNVRVATWLGDDGDAGTIECPERVLTGFAKCESLRSIRDRNLDELRARLVLAREGWPVWLRDATSSLYQWRSPGRFVALAQRWKAAGVAPEHASDYGAIEAWRYNDHHLWRWEHDQRLNSTRYRREVYRIAVAELSRRYRRAILMAADWAEMAKLPGIGEGAPDLPDEARAQRVETAPYVLTEALHSAMTEVVWVDPSYLSQACRHCDHKDTGDTWVRECTSCGKARDIDEAAVRTMLDLEEAGAWSWKKGGAKDESGKVREIRAPKWAKKHATEAAE

SEQ ID NO: 123 - protein, 600 aa, Unknown
  source: /note="Description of Unknown: aquatic-marine-pelagic marine sequence"
MISRVYKYGAVPLKKFPEVKFPREQFPEEGVEELRRANKLRNSLVWLHRKNNEKFEAARVAADAEYGEIAEKLDALEKTISQALTAKRQARAKAGTRDAKHPLVKAASETINELTKQRSDLWKALKPARIRADKRVDRKALTKQFDDAVKVVQHVKETGGLSSHCANEIVRYFKESRSRALNERATLRYRRFDGTGFWFYRFREPGVNKNGVDFDGLLTGNKTEARDNRNFVLTEKSRRGKRVIYKLRAKIAGGAKKDSKVYGHFDLILHRPIPENARIQSAKILRHRTGDKFTYTVSFTLKLPDVEQQTVEGSVLGLDIGFREMERNNSYRIATLATNDQSRRVETIDIARENRRGFLARMNHIDDLRSTMDENATELGKKLLPLLKTAKPLPDSHQQFIFTERLRKTRANVTLDFERSYKMARWFIRAPDEADFYGPEIVGMVLRWWEENSFKYREMHNLRRKALAERKEVYRMEAARLVGFGIPIAVEKLDMSKWAERKDSDNELSNRALSSRFLVAPSELIAAIENAAKREGVPFIKVNAANTSKACHACGTINKALKGELIWTCEECETKHDRDINAAINIAKRGILQAKKEKKQ

SEQ ID NO: 124 - protein, 642 aa, Unknown
  source: /note="Description of Unknown: aquatic-non marine saline and alkaline-hypersaline lake sediment sequence"
MTKTYVYGLPLGPTVNADLVEEQMRLAHKYRNALIEIERERREKVREVYDERDLALEGLVEEDKVAKSELKRATEDLKRQRAKTRSRSDTAEQRARVKEARKAAQEVAKRLSEARKELKLDEELQKRLSEANLTASEKSQAAQQGFSREGLFWGTYLQVDNAMEDSRRDLKMWDEHGQPLDPKFLQWRGDGTVAVQLQGDKHPVEKIFSGEDTFLQVDMEPPPEGVVSKTRRKKRRGVMRLRVGSTKSRGPVWAEFPIIMHRPLPQGVRIKWAVVKRRMISDRPRWTVHFSLGLPAEYQHEEFGSGRGAVAVDIGWRKRGEDQIRVAYLVDGDEYAAYLRDRQDPLGRGDELLMEPEVVRGFDKVESLQSIRALNQNEMQKSLKGWIKSNKKNLPEWFREDVRYLHSWKSPKRYAGLLRKWGEKRWDGDGEGFQILKDWLSGTYEESLGRRDGGDRHLWQWKESQEQKSLRRRKDHYRRVAAKLARKYKVLVIEDFKLTETQKHEPPESEKVEIQAARNQQKEAACYELRMMFVQAFLARGGTVVWVDARMTTQRCFECGCLEPWDAIPEVDHVCVECGAKWDQDANAARNIMRLYRNDETLKMIDGSVPVEPKMSRRQKGRKKGKKIVQQRKSQEAAQPSV

SEQ ID NO: 125 - protein, 732 aa, Unknown
  source: /note="Description of Unknown: aquatic-non marine saline and alkaline-hypersaline lake sediment sequence"
MTRKTSKTKRKKKPGKPRVRGPQLAYVYGLPFGPTKNAELVEKQIVLSQRYNNQCVEAERRLRATLREIYQQHTLDLMGASDEMREAFTEVKRLEKLLREMQEDLRTKRKRSRSRSDTPQERMRLREVRDLKNEAWAKLRELKNGSESDDEPGKEEPRKKVELSDELKARRAEAQQREKQELHEAYVQFKDGTYEKVTETDEELGKLYWGTYLLVNRAREASRMSLRDSLWKWNEEKGIWVERDPKFKSLDDEVIFGVELQKGDSVERVLNCQNTMFQLDMEPEMGEEVLRHRRIRRRGIARIRVGSGGKSGRDPIWAEFPVIMHRPLPPKARIKWAVVKREKITTRLRWTLHLHLEVDSGDCHKDYGTGRGVVAVDIGWRKRGTETVEMGRKRKKRGLRKQEVEVPRIRIAYLIDDREYAAYLKNPDEGEVGHEQCMSSKVVAGFQRVETLQQTRQLKQNEMLAELRAWIKARRSALPKWFRESTRGIAKWEAPKRFAWLLRLWRESRWKGDERGFEILDRWQRGVYDEEARRLEGGDRHLWQWQESQRRKSLLQREDHYRCVDSALAREFKVLVLENIDLSKMQKHELPGSDKVEIRRARRQQKEAALSEFRETLIQAFLSRGGTVVWVNPAMTTQRCFDCGHDAPWDPIPKVEHTCEKCGRTWDQDANAARNMMRLYRENKIVKIADGSVLVREMSDAQKNRNKGKKVVRKRKKEEEERNGEGPAPLES

SEQ ID NO: 126 - protein, 584 aa, Unknown
  source: /note="Description of Unknown: aquatic-non marine saline and alkaline-hypersaline lake sediment sequence"
MRVYKYGLLRPTTNADLVHEQIKIGHKYRNKLIELEIKRRDLIRAEVAKSSVVEDDFTDAKLAVEKFKHLDKLLKQKNAQHRSKRHNNPDLKKDHTKARKEKTKAIKKLEETRRKVLKKCKETIKVFNDQYIEEEKKVRSECAPFWGTYQVIEDAMKRSRKSLPLWDGLESNNPKFRRFNGIGRVSIQLQKDVIDKNNGMNVDLVFGTTDTRLQVAPVPEEAWYSPIRSVRRKKSRTVLKMRIGSEGRAPIWAEWPMIMHRPLPDNGRIKRVTVNFRKIGPREEWTADFFINDSATLHEQYEVSGAIGLDVGWRLMDDGSLRVAFWEDDEGEKGEFRLSPTLMGAFKKADDLRSIRDKNRDEIKEFLIQHFSKNPMPSWMLDFVKGKEDSKRPTNKQACVYLSKWKSIAKLTKLVQTWKEKGITKRHQKAYNRFEDWRYHDFHLWQWETSQRKKAERRRKDNYRVLASKLSKQYHTLVLENFDLRKVARKKAADDDSLDIKAANHNRFVANISELRLVLRNAFEKCGEIELVKAVNTTKICFWCGFINNFDQAKNLIHQCYSCGVVWDQDDNASTNIRRRRKQG

SEQ ID NO: 127 - protein, 654 aa, Unknown
  source: /note="Description of Unknown: aquatic-non marine saline and alkaline-hypersaline lake sediment sequence"
MGAARRRNPKVAAARKGKPPPKATGNCRNYRYGAHEPIANLDKVLDEMRGAHDLRNVLTCINRARSEMITAALGEHQSYKKATADLAALHQRRDKLEAQIRQQNSASRKRLGRHSPLSSELDTVRKRIDEGRTALKKLRRKLLKKDPALKAVVEAADDMAKRETTRAEDACGLYWCTRNEQTGKRAKLRRFKKWRDSEATISVQIPGGLTVEQLLGGENNQARLELRPEGVWVQGARKRKVEPAEAARNKLRLDEDGYPMRKLGTAILHLRCMSDEDGKPIWAEVPITYHREIPADAKIKRCYLHRFRVGNRYHWSVRFSLERGKKGDDSWLHPRVATTGTAAIDIGWRWFPDRLRVAVWAGSDGAEGELCLPKWWLDEMYSVRLDQRERDVLFNEIVSLVLPWFRSRRGELSDYVVQAIKTMHSWRDKGRLAALSMRWRDDLAADPGANPAHVAMSIRLEEWRKRDKHIWCEEVNLRSQLQGSRKDLYRRFAAMLTSRYGRIVVEEFDLSAVQKLPPASIDDGTYSRVKRHKGDAACSHLVGALKDAARQLDKKNPKWTTKRCHVCGKTERKWENPGELEHTCKHCGVLWDRDVNAARNILAASGVAVDWTRPPLAPAARMTYPQVENREMRRSRRRKEALETTRASGDRQTA

SEQ ID NO: 128 - protein, 670 aa, Unknown
  source: /note="Description of Unknown: aquatic-non marine saline and alkaline-hypersaline lake sediment sequence"
MLKRGERGERGERGERGERGERGASMPRNPKKKMDGVGRNYKYGAYAPLTNEDEVRWQMVLGHRYRNRLVEVELDIRAKRDAIIQEVAPGLLALEDEINKMGEIIALHEKAQKEQNKKQRGRDVHPGVANLLRDLKAEKKGLVGKRKALKAELFASDRWKQDGGDHLNQQRKEGRSNAYSEYKDEGLWWGVRSKILRESGSFISGAPPKFRGWHKSVRSTRFVVQTQGGLTEEELLSGRNTTARLTLFPDGVWAEGKRRPKRMGDAILDLRIGSDEHRKPIWTSIPISYDRHLPAEAKIKWIYLFKRLLVDKEKWEVVFALECPAAADYDAIRRRGGDKKRTNRNRKGIRLRKYAQSGVVAIDVGWRKFEDYLLVGTCAASDGREWELRLDGNWLGQLRRVEGMQSYRDVLLNEQVKWLHPWLKSRKGSLPELLLPPSRNLEKWGQRSVARLVKQWMRERPIGTLDEQRALARLDEWLSRENHVWHFQANLQHQLLLYRREEYRVWARRIGEVYRCVVLEKLNYGDWHKKPPVERGGSVKADMAKKYLRDAGLSHLKNALKGGVLQVADVPHEGTTVNCHACGHADVWEDPAAKDHVCETCGLRWDRDVNAARNILAASGVTVAWEREPLAPTEAWTACSKSGLNRAQRRAISSSLAIDSEIALAVGGSE

SEQ ID NO: 129 - protein, 645 aa, Unknown
  source: /note="Description of Unknown: aquatic-non marine saline and alkaline-hypersaline lake sediment sequence"
MPRNPKKKMDGVGRNYKYGAYAPLTNEDEVRWQMVLGHRYRNRLVEVELDIRAKRDAIIQEVAPGLLALEDEINKMGEIIALHEKAQKEQNKKQRGRDVHPGVANLLRDLKAEKKGLVGKRKALKAELFASDRWKQDGGDHLNQQRKEGRSNAYSEYKDEGLWWGVRSKILRESGSFISGAPPKFRGWHKSVRSTRFVVQTQGGLTEEELLSGRNTTARLTLFPDGVWAEGKRRPKRMGDAILDLRIGSDEHRKPIWTSIPISYDRHLPAEAKIKWIYLFKRLLVDKEKWEVVFALECPAAADYDAIRRRGGDKKRTNRNRKGIRLRKYAQSGVVAIDVGWRKFEDYLLVGTCAASDGREWELRLDGNWLGQLRRVEGMQSYRDVLLNEQVKWLHPWLKSRKGSLPELLLPPSRNLEKWGQRSVARLVKQWMRERPIGTLDEQRALARLDEWLSRENHVWHFQANLQHQLLLYRREEYRVWARRIGEVYRCVVLEKLNYGDWHKKPPVERGGSVKADMAKKYLRDAGLSHLKNALKGGVLQVADVPHEGTTVNCHACGHADVWEDPAAKDHVCETCGLRWDRDVNAARNILAASGVTVAWEREPLAPTEAWTACSKSGLNRAQRRAISSSLAIDSEIALAVGGSE

SEQ ID NO: 130 - protein, 625 aa, Unknown
  source: /note="Description of Unknown: aquatic-non marine saline and alkaline-hypersaline lake sediment sequence"
MGNVPLLEQQTKEAGERVSEASKSVKQYRSKNRTRKVPEWMRTELDAARLAKKDVAAKLREVRKQLRTPEIQAEMDRINGLAGELRRSARAHCGLYWGSYLLVEDEMASSSKSPLYDKENPNEPNDPGFVRWHGEGHLGVQIQGGMPTGLVQFHSTLLQIKKVDPVEGKLGKSHYLLRMRVGSNGRKPIWGEWPMVMHRPLDPGQIKGAAVSCRRIGLRWQWTVEITVDKESGCRPRPCGYGQVAVNFGWRKVDGGIRVAYAVDYEGNEQELVLPDGEAEGIVRPSRVRERLTDEQRAIQKRDGIIYGKACRLSDDGKSYEAEKVLSGRPDLLSRLSSRVRPARKPPILPALRKSDELRSIRDQRFGHILQSLIKWLKTIEVPCWLKDRTSHIHKWKSQNRLRKLIGYWRSNRFDGDETMFQSLEVWNHRDEHLLSWEDSQRKKSQRRRRDLYRVWAAKLADRYYTIVLNSHDMAETARKPKVEATDDIPLSRSNRQLVSPSELKEALINAKRSREGQTVENPAQKVTHTCHNCETEQDFDAASSIEHTCLACGETWDQDRNAAINSLRWFVERPSDAKILGTARKIKNLDENGVEKETRRQRISRLKREKDARMKALANDAASS

SEQ ID NO: 131 - protein, 645 aa, Unknown
  source: /note="Description of Unknown: aquatic-non marine saline and alkaline-hypersaline lake sediment sequence"
MPRNPKKKMDGVGRNYKYGAYAPLTNEDEVRWQMVLGHRYRNRLVEVELDIRAKRDAIIQEVAPGLLALEDEINKMGEIIALHEKAQKEQNKKQRGRDVHPGVANLLRDLKAEKKGLVGKRKALKAELFASDRWKQDGGDHLNQQRKEGRSNAYSEYKDEGLWWGVRSKILRESGSFISGAPPKFRGWHKSVRSTRFVVQTQGGLTEEELLSGRNTTARLTLFPDGVWAEGKRRPKRMGDAILDLRIGSDEHRKPIWTSIPISYDRHLPAEAKIKWIYLFKRLLVDKEKWEVVFALECPAAADYDAIRRRGGDKKRTNRNRKGIRLRKYAQSGVVAIDVGWRKFEDYLLVGTCAASDGREWELRLDGNWLGQLRRVEGMQSYRDVLLNEQVKWLHPWLKSRKGSLPELLLPPSRNLEKWGQRSVARLVKQWMRERPIGTLDEQRALARLDEWLSRENHVWHFQANLQHQLLLYRREEYRVWARRIGEVYRCVVLEKLNYGDWHKKPPVERGGSVKADMAKKYLRDAGLSHLKNALKRGVLQVADVPHEGTTVNCHACGHADVWEDPAAKDHVCETCGLRWDRDVNAARNILAASGVTVAWEREPLAPTEAWTACSKSGLNRAQRRAISSSLAIDSEIALAVGGSE

SEQ ID NO: 132 - protein, 674 aa, Unknown
  source: /note="Description of Unknown: aquatic-non marine saline and alkaline-hypersaline lake sediment sequence"
MIVYQYGLRAPTSQIELIHDQLWLSHRYRNTLVEIERGRRAAVRRLNSTVGNVPLLEQQTKEAGERVSEASKAVKQYRSKNRTRKVPEWMRTELDAARLEKKDVATKLREVRKQLRTPEIQAEMDRINGLAGELRRSARAHCGLYWGSYLLVEDEMASSSKSPLYDKENPNEPNDPGFVRWHGEGHLGVQIQGGMPTGLVQFHSTLLQIKKVDPVEGKLGKSHYLLRMRVGSNGRKPIWGEWPMVMHRPLDPGQIKGAAVSCRRIGLRWQWTVEITVDKESGCRPRPCGYGQVAVNFGWRKVDGGIRVAYAVDYEGNEQELVLPDGEAEGIVRPSRVRERLTDEQRAIQKRDGLIYGKACRLSDDGKSYEAEKVLSGRPDLLSRLSSRVRPARKPPILPALRKSDELRSIRDQRFGHILQSLIKWLKTIEVPCWLKDRTSHIHKWKSQNRLRKLIGYWRSNRFDGDETMFQSLEVWNHRDEHLLSWEDSQRKKSQRRRRDLYRVWAAKLADRYYTIVLNSHDMAETARKPKVEATDDIPLSRSNRQLVSPSELKEALINAKRSREGQTVENPAQKVTHTCHNCETEQDFDAASSIEHTCLACGETWDQDRNAAINSLRWFVERPSDAKILGTARKIKNLDENGVEKETRRQRISRLKREKDARMKALANDAASS

SEQ ID NO: 133 - protein, 645 aa, Unknown
  source: /note="Description of Unknown: aquatic-non marine saline and alkaline-hypersaline lake sediment sequence"
MSRFHKDRLKVDAKIFSFNASEPMEGLEVIRSEMKLAHDYYNKLVELERARRSEIEEEQLRRFPELLRIEEEIAVAEDSLVDLVRETKRRNSSRRSAKLPKEDRERIKIARGVLRELCKRRSEMKKGLRENADYQEAEKGITKKAKGAAKEARHESGCFWPNYLQVEVAVESAKKPRKRRKGQRPVRWTYRPRFKRWEGRGRVSMQLQKGLSPERLESGADTRLRLVRGRVTKPGPRRERKQGTAMLWIRVGSTKEPGKRAQPVWAKVPFYYGGKRDRELPPDCSIKWCWLLVDKIGLKERWRVQFSIDAPLGTLKHVDRASDGTVAIDIGWRLMGDRLRCAIWSGSDGEEGEIALTGSWVRAYSRERAMRSYRERLFNCVLKELCSWAKEQEVLPEPLAEARALHAWKKHGKLASLSLKWRGKRDFRERSEKAASYLREGGVVDLSGASEDDVLALLEGWRKRDKHVLEYESHLRDKLQATRLDLYRVCVANLRRRYKTCVLEEDVEDDERTKLMDLVKWHLLPDVIEAGDPGEEEQRRASKRGLRPACLFKLRAILKENMEIVGVPSEFTTKRCWSCGSVEEWDQASEVEHTCENCGETWDQDVNAARNLLVASGVEATFFRPALAPAEVWTCGLRGTFPEPV

SEQ ID NO: 134 - protein, 556 aa, Unknown
  source: /note="Description of Unknown: aquatic-non marine saline and alkaline-hypersaline lake sediment sequence"
MFGHDSLPSRIYRYGAKAPTVGAENVDRQMSLGHRYYNTLVEIERRRREKAAALVARVSPALASLEQRREALTAAIAERREAVKKSNQEVRKKQATKDERDAIAALTAERKEVNVLYRDAKDLAYNSPEAAAGLAAIDQQADMEAKTARAESGLYWGTYLQVEQSLPRKGPPPKFHRWMGDGKIAVQIQGGMTLEEAFAGRDQRFRLEPIPDNAWDKGNRKHRRTRAWIRVASDGRDPVWAVVPVVLHRPIPDDAQIKWVYLLRRRVGCNNNWSLCLVISRQAWQRHDLAGDGAVGINLGWRKVEGGIRVATWVGDDDESDTLVISERDAGRWQKAKDLRSIRDGRFNAIQEALVDWLGSHAVPEWFSERTATIKQWRSQARLAALVIAWRSQRFEGDEGIFPAMEAWRKKDKHLYEWEANQRRKAVAWRNDLYRCFAAKLSQRYETAVLGKTDWKTIGRRPSPENPEHASGGENRTLASPGILQRMIVERVARVELADAKHITQRCHACGKLASFDARTNIFTTCRHCAETWDQDENAARNLLLSASGPVAQKTP

SEQ ID NO: 135 - protein, 572 aa, Unknown
  source: /note="Description of Unknown: aquatic-non marine saline and alkaline-hypersaline lake sediment sequence"
MRVIVYEYGLRQPTSGIDDIDDQIHRAHRYYNKLIEIERWRRAQVKKAQLQVPEVANTKKVVEALREDLEALRTQHKRAKSHDGKTHPPRAGAIKDTTAALKAARQGYRQAKKDAADILKPLYKKVDEERNALVRQARGESGVYWGTYLCIEQFASQAAQTAKRESPDFRRWTGDGMLAVQIQNGLDAGALFGDDTRVQVAPIDSKAWDKSISRGKRKRMQYTTLRLRVGSTGPGNREPVWAEWPLFMHRELPADASIKWVRVIRRRWDQRWKYRWVVQFTVEVPEAPGWQGEGTRKGMVAINLGWRKLATDALRVATWVDTEGNVGELQLPVSFRQRLEKANSIRSIRDRKLDELKAAIVPLLPECSRWKSPKRFEGLLRQDDLPDGVRDLVNKWAYRDRHLWWFERGCRQGALRYRREIYRLFALEMAKKYPLVIVEDYDLRPIVTDENRIKLPSHQRVEGSPSEARHVLLASVSRLGGMVIDGKSKLATQECHLCGYGKEKDERWDASPKIEHTCVGCGENWDQDVNNARVLLARAQVMLESGELLAQPKPKRSARFAKKHKKQNEAVL

SEQ ID NO: 136 - protein, 556 aa, Unknown
  source: /note="Description of Unknown: aquatic-non marine saline and alkaline-hypersaline lake sediment sequence"
MFGHDSLPSRIYRYGAKAPTVGAENVDRQMSLGHRYYNTLVEIERRRREKAAALVARVSPALASLEQRREALTAAIAERREAVKKTNQEVRKKQATKDERDAIAALTAERKEVNVLYRDAKDLAYNSPEAAAGLAAIDQQADMEAKTARAESGLYWGTYLQVEQSLPRKGPPPKFHRWMGDGKIAVQIQGGMTLEEAFAGRDQRFRLEPIPDNAWDKGNRKHRRTRAWIRVASDGRDPVWAVVPVVLHRPIPDDAQIKWVYLLRRRVGCNNNWSLCLVISRQAWQRHDLAGDGAVGINLGWRKVEGGIRVATWVGDDDESGTLVISERDAGRWQKAKDLRSIRDGRFNAIQEALVDWLGSHAVPEWFSERTATIKQWRSQARLAALVIAWRSQRFEGDEGIFPAMEAWRKKDKHLYEWEANQRRKAVAWRNDLYRCFAAKLSQRYETAVLGKTDWKTIGRRPSPENPEHASGGENRTLASPGILQRMIVERVARVELADAKHITQRCHACGKLASFDARTNIFTTCRHCAETWDQDENAARNLLLSASGPAAQKTP

SEQ ID NO: 137 - protein, 630 aa, Unknown
  source: /note="Description of Unknown: aquatic-non marine saline and alkaline-hypersaline lake sediment sequence"
MYRYGLLPPSSGAELVDEQMWLVHRYSNELVEIERARRKGFHAALAVVPEVAEALRVEEEALARYHVLRDSDSDDRAAEFRKKGKRRRKSSPAVADALAALKAATDAVEDVRAAAVKAIGRDSKKKKTAKKKKKKKTATELVKMTPAEVASVTEAINENDAVHGDAAKRKRAEFIAQGLYWGNYQVAEASIPRKGPPPKFRRWEGRGHIAVQIQGGMTYAELLSCNHTMARLEIRDDWGSNRRTSRHGLLWIRVGSKGKGGREPVWATFPVCWHRHLPEGARIKRIDVTRRIQGVRAVWAVCVTVQTPGASLTKQALVKPVTKALPKAVGLDVGWRSTDDGGIRVAVLYDGDRHYEVALPHWFAEGDRLVSDLQSIRRCRFNAVKDQLLAALREGKHKEQAETFATLASWDSQARLARAVREWEGCPAYLTEWRAKERHLYQWERDAKRYLVEWRKNWYCHWVAWISQRYKNVVIEKFDIAKIKKKAEAGEDKEEATGPHSLAAPGELRRILLSTCSREGVQVHLAPAGNTTRKCSVCGKLRRKKKGEGVALMQECSGCGRVMDQDANASRNLYGFASAGVIPETPVAFAVPEAAWYGRFSLTPKKIQSRVARLQAALETSPPDSDGKGG

SEQ ID NO: 138 - protein, 643 aa, Unknown
  source: /note="Description of Unknown: aquatic-non marine saline and alkaline-hypersaline lake sediment sequence"
MAFHHSTQPTTSRVYRYGLLPPSSGAELVDEQMWLVHRYSNELVEIERARRKGFHAALAVVPEVAEALRVEEEALARYHVLRDSDSDDRAAEFRKKGKRRRKSSPAVADALAALKAATDAVEDVRAAAVKAIGRDSKKKKTAKKKKKKKTATELVKMTPAEVASVTEAINENDAVHGDAAKRKRAEFIAQGLYWGNYQVAEASIPRKGPPPKFRRWEGRGHIAVQIQGGMTYAELLSCNHTMARLEIRDDWGSNRRTSRHGLLWIRVGSKGKGGREPVWATFPVCWHRHLPEGARIKRIDVTRRIQGVRAVWAVCVTVQTPGASLTKQALVKPVTKALPKAVGLDVGWRSTDDGGIRVAVLYDGDRHYEVALPHWFAEGDRLVSDLQSIRRCRFNAVKDQLLAALREGKHKEQAETFATLASWDSQARLARAVREWEGCPAYLTEWRAKERHLYQWERDAKRYLVEWRKNWYCHWVAWISQRYKNVVIEKFDIAKIKKKAEAGEDKEEATGPHSLAAPGELRRILLSTCSREGVQVHLAPAGNTTRKCSVCGKLRRKKKGEGVALMQECSGCGRVMDQDANASRNLYGFASAGVIPETPVAFAVPEAAWYGRFSLTPKKIQSRVARLQAALETSPPDSDGKGG

SEQ ID NO: 139 - protein, 651 aa, Unknown
  source: /note="Description of Unknown: aquatic-non marine saline and alkaline-hypersaline lake sediment sequence"
MSTKVYKFRLYAPILNGDLVEEQLKLANAYRNKLIELERDRRVVARELNAERRSVLGEYIDAAEELKTRLKREVNRLKAMKAMKARGARKSPELKDQEKLVTQIRQERKAAVEDLKAREANLKTTSELQAKYDKLWEDLTNKTKEERNLNGLYWGTGGFQEQAMQKSSETLHLGKDPRFKRWDGCGTVAVQVQKPLQMPLKDFFHGKSTLINFIMDDEGASGTKRHGVVQLRVGSDRKKPIWAEWPLVMHREMHERAVITGAQIHKTRTADKFKYHLCVTAKLPDDVRKERCGDGVVALDIGWRKLLDGNLRVAYWKDREGNGGQLVLDPAVLSGLGKDASLQAICRGLLNKLYKAFYTWLSSVANLPENFQQIYEEMTAEKAYWKEFRALQKIVREARAGGLPELDALEEKLAEMKARQKEVRTWKVQGKFSGLLEDWRNNRWDGDNAGFTMLDDWWRGTYNPESGHREGGCKHLWQWRSNQREKSQRRRKHQYRNLGAEFSRKAGVLVLENFDLTDMQRDAEPEEKKKNPEAKLNQRYAACYELREAFIQAFQSRGGRVVKIDPQMTTQICARCGCDTRWDAALEIEHTCERCGATWDQDENAADNLLKLYEGGGSIQEVTVVKKDPRWKRLKAEKAAKLEDRGGARKD

SEQ ID NO: 140 - protein, 633 aa, Unknown
  source: /note="Description of Unknown: aquatic-non marine saline and alkaline-hypersaline lake sediment sequence"
MVTEYTTKVYTCGLRPPAENADLVSEQIRLGHRYYNRLIEIEHEKRQRDHEIVGAHGDADALQAAIDEQVVVVEQVVARIRRWRIANGKKVASKDLRMELAAAKKSLKAARAELRELRRVIKQDPEIAASRVALWAEDSAARKRARAECGIPHGTYIQVEQAVEAACKAPMAPGCETPWWELPRFKRWKGEGCVGLQLQQRDGEYMDTDALFGRSDPRLQIDPVPSTAWDRRRSREQRTVVRMRIGSECRRCGALCTSIHCPEGGDGGAAYRSPVWASWPMILHRPLPEGALIKWAKVKRERIVGKARWRWSLHLTIDEPEQEPRCGEGTVAVDVGWRKTETGMRVGYWQDDSGDHNSINIDHEILDRLRKVDELESIRKRNMNAAKSQLRAWLATWEEVPDWMREASRHMHAWRSQNRLAGLALHWRQNRWEGDNPGYEDLEDWRKQDKHLWAWQDNLRGKVLRRRREVYRVAAARLAERYDTVVLTDFDLRDTQRHPSDTSTREEIDAVKWQQKAAACSVLRGCIRNAFTSRGGRIVEVEAKLMSRTCHGCGHDGEWAKPEELEHTCQGCGETWDRDVNSTTNMLRAARERSDDDDGRPKKRAAKWAKRHGRSKNENDDDGTSRNAGDKVA

SEQ ID NO: 141 - protein, 549 aa, Unknown
  source: /note="Description of Unknown: aquatic-non marine saline and alkaline-hypersaline lake sediment sequence"
MFGHASDPSVIYRYGALPPTHNLDAAFEQLRAAHRYRNKLVEIERDRRDKTAAVVSAASPDLAGLESQYAELGERTAAAAKQIKATNQRARAQRATPEQKAVLRKLRAECKDVYSRLKEAKALAYKSLEARTALDQADAAALNAAKKARAECECYWGTYLQVEQGLSGIRKGAPPRFLRWTGNGKLAVQIQGGMSREEAEHGDGRLRIATTERRGKATNVYLRIGTNEDRSPIWAVVPVIFHRPIPDDARIKWVYLTARRVACHTRWHVCFVLSRAEGWRKPDLATSGTVAVDLGWRLLDHGLRVGYWRGSDGGSEEILLPTRDVARWQKADDLRAIRGERFNGVVDWLAKWLAGRDLPDWLIERTRTLRQWRSAARLASVVIHWRENRFAGDKDGFAAVEAWRKKDKHLYEWEANQRRKAVAWRDDLYRRVAADLSRRYKTAIVEDCNWRDVGRKPDVGENNDSGAAARQRTIAAPGRLKQLLVERFAETVKAEAAYTTQRCHACGELAHVETRTSVWVTCQQCGAAWDQDDNACRNMLDMVAKGPVT

SEQ ID NO: 142 - protein, 642 aa, Unknown
  source: /note="Description of Unknown: aquatic-non marine saline and alkaline-hypersaline lake sediment sequence"
MTKTYVYGLPLGPTVNADLVEEQMRLAHKYRNALIEIERERREKVREVYDERDLALEGLVEEDKVAKSELKRATEDLKRQRAKTRSRSDTAEQRERVKEVRKAAQEVAKRLSEARKELKLDEDLQERLSRANLTASEKSQAAQQGFSREGLFWGTYLQVDNAMEDSRRDLKMWDEHGQPLDPKFLQWRGDGTVAVQLQGDKHPVEKIFSGEDTFLQVDMEPPPEGVVSKTRRKKRRGVMKIRIGSTESRGPVWAEFPIIMHRPLPQGVRIKWAVVKRRMISERPRWTVHFSLGLPAEYQHEEFGSGRGAVAVDIGWRKRGEDQIRVAYLVDGDEYAAYLRDRQDPLGRGDELLMEPEVVRGFDKVESLQSIRALNQNEMQKSLKGWIKSNKKNLPEWFREDVRYLHSWKSPKRYAGLLRKWGEKRWDGDGEGFQILKDWLSGTYEESLGRRDGGDRHLWQWKESQEQKSLRRRKDHYRRVAAKLARKYKVLVIEDFKLTETQKHEPPESEKVEIQAARNQQKEAACYELRMMFVQAFLARGGTVVWVDARMTTQRCFECGCLEPWDAIPEVDHVCVECGAKWDQDANAARNIMRLYRNDETLKMIDGSVPVEPKMSRRQKGRKKGKKIVQQRKSQEAAQPSV

SEQ ID NO: 143 - protein, 560 aa, Unknown
  source: /note="Description of Unknown: aquatic-non marine saline and alkaline-hypersaline lake sediment sequence"
MFGHKADPSLIYRYGAKTPIEHCDVVDAQIRAAHRYYNQLVEIELRRREQATELVRSLSPELDTLTEWREELSETIDSVRAEIKAANQRARRKTTTKAQRDQVKALRKQRKAVTELWREAKAAAYDSPDAKAGLAAIDEAANESRRQARAACGVYWGTYLAIEQSIPKTSAPPTFHRWTGDGRVVVQLQGGMSAAEAFACRDNRFRIEPVPEEAWDRGQPKRLQRTRAWVRVDSDGRDPVWAVVPITLHRPFPEDCRIKWVYLIRRKVASKDKWSLCLVLSRVEGWQKTDLGASGSVGIDLGWRLVAEGLRVAYWAGDDGESGSVVLPMRDVGRWQKARDLQSIRATNFDAIVLRLAGWLAGRELPDWLTERTKTLRQWRSQGRLAAVVIQWRAERFDGDAEIFAEVEAWRKQDKHLWEWEHNQRRKAIAWRENVYRQFAAMLSRRYRVVCLEATDWRHFMRKVAAEEDGQGGAGAQRYLRIASPGQLSRLLAERFAEVVRVDPKHTTQRCHVCGELAQFDAATSLHTKCRHCGAEWDQDYNAARNLLGAASGPVPQETP

SEQ ID NO: 144 - protein, 567 aa, Unknown
  source: /note="Description of Unknown: aquatic-non marine saline and alkaline-hypersaline lake sediment sequence"
MFGNKALPSVIYKYGARRPVTNADEVDRQVRDAHRYRNKLVEIERDRRSCVNAKLMQLAPRLLSLETEIERLDNLIAEKRSEIKRANATRRRRDVTPEQRAELRQWQADRKALRTELKERKADAFADPRIRTALAKVDAEALAASKAARAASGVYWGTYCQVEQSLSGMRSGAPPRFLRFDGTGKLAVQLQGGLSVAKAFAGEDRRLIIEPVPPKAYLPGEPKALQRTRVWLRIGSDGREPIWTIVPITLHRPLPDDASIKWVYLTRRRVATKDRWSVCFVLARESGWQKPGLARNGSVGVNLGWRVMDDGVERGLRVARWVGDDGTEGELRLPMPDVERWKKTEDLQAIRDQRFNAAVSLLADWLADPGCLLPDWLVERTATLRQWRSAARLAAIAIQWRGERFEGDDTAFATLEAWRKKDKHLYEWQANQLRKAIAWREDLYRNLAATLSRRYHTVCLANTDWRDLARRPTAEQAETDAGARRYQRVASPGALGRLLRERFAETVTVDSRHITQRCHACGEVNQFDAAAHVRATCRHCGAEWDQDINAARNILRAASGPVACETP

SEQ ID NO: 145 - protein, 575 aa, Unknown
  source: /note="Description of Unknown: aquatic-non marine saline and alkaline-hypersaline lake sediment sequence"
MRLANRYYNCLVVIERERRQAVRDALQECDQRHGIDALQDVVDTLKTQRDEAREEIKRARSKTRSRSDTEDQRKRVKDLTVQIKEACELVKRARRDIRDDEQAKEQMKAADNIARTKTREARAICGVFWGTYLTIEAAIDAARKAPLWQYGKPNDPRFRRFGGRGSVSMQLQGGLAASDVFGDDRRLQIELSPQRKSNSNRSKIRRYGVIRLRVGSSKRDPIWAEWPLLMHRQLPDLSTIKWARIVCDRVANEERWSLQLTIDIPEPVKVSDERKGTVAINPGWRLLDYGVRVGYIVDDCNETDEIVIDPGVLSGLRKVEDLRSIRDRTQNTMMEEFLPWLRSHKNILPAWLTERTKTIGQWKAAARFAALAHVWSVSRFGGDVLGYELLEQWRKQDLHLWQWESFQRRKSIGRRRNQYRRLAKQLAHRYHTLVLDTTNLAEIQRHKSTESEEIEIPAARLQQRDAATAELRSYLAEAFHATGGVVVKVNHKRATRRCHVCGHEGPWNQCDEVVHKCESCGSSWDQDENNCRNLLERLGDGDKITTKRQAKWDRLGRHNKTARKLDDNDVEIQTN

SEQ ID NO: 146 - protein, 598 aa, Unknown
  source: /note="Description of Unknown: aquatic-non marine saline and alkaline-hypersaline lake sediment sequence"
MPTKVYKYGVRPPTKNADIVHEQMRLANRYYNCLVVIERERRQAVRDALQECDQRHGIDALQDVVDTLKTQRDEAREEIKRARSKTRSRSDTEDQRKRVKDLTVQIKEACELVKRARRDIRDDEQAKEQMKAADNIARTKTREARAICGVFWGTYLTIEAAIDAARKAPLWQYGKPNDPRFRRFGGRGSVSMQLQGGLAASDVFGDDRRLQIELSPQRKSNSNRSKIRRYGVIRLRVGSSKRDPIWAEWPLLMHRQLPDLSTIKWARIVCDRVANEERWSLQLTIDIPEPVKVSDERKGTVAINPGWRLLDYGVRVGYIVDDCNETDEIVIDPGVLSGLRKVEDLRSIRDRTQNTMMEEFLPWLRSHKNILPAWLTERTKTIGQWKAAARFAALAHVWSVSRFGGDVLGYELLEQWRKQDLHLWQWESFQRRKSIGRRRNQYRRLAKQLAHRYHTLVLDTTNLAEIQRHKSTESEEIEIPAARLQQRDAATAELRSYLAEAFHATGGVVVKVNHKRATRRCHVCGHEGPWNQCDEVVHKCESCGSSWDQDENNCRNLLERLGDGDKITTKRQAKWDRLGRHNKTARKLDDNDVEIQTN

SEQ ID NO: 147 - protein, 610 aa, Unknown
  source: /note="Description of Unknown: aquatic-non marine saline and alkaline-hypersaline lake sediment sequence"
MWLVHRYSNELVEIERARRKGFHAALAVVPEVAEALRVEEEALARYHVLRDSDSDDRAAEFRKKGKRRRKSSPAVADALAALKAATDAVEDVRAAAVKAIGRDSKKKTAKKKKKKKTATELVKMTPAEVASVTEAINENDAVHGDAAKRKRAEFIAQGLYWGNYQVAEASIPRKGPPPKFRRWEGRGHIAVQIQGGMTYAELLGCNHTMARLEIRDDWGSNRRTSRHGLLWIRVGSKGKGGREPVWATFPVCWHRHLPEGARIKRIDVTRRIQGVRAVWAVCVTVQTPGASLTKQALVKPTTEALPKAVGLDVGWRSTDDGGIRVAVLYDGDRHYEVALPHWFAEGDRLVSDLQSIRRCRFNAVKDQLLAALREGKHKEQAETFATLASWDSQARLARAVREWEGCPAYLTEWRAKERHLYQWERDAKRYLVEWRKNWYCHWVAWISQRYKNVVIEKFDIAKIKKKAEAGEDKEEATGPHSLAAPGELRRILLSTCSREGVQVHLAPAGNTTRKCSVCGKLRRKKKGEGVALMQECPGCGRVMDQDANAARNLYGFASVGVIPETPVAFAVPEAAWYGRFSLTPKKIQSRVARLQAALETSPPDSDGKGG

SEQ ID NO: 148 - protein, 642 aa, Unknown
  source: /note="Description of Unknown: aquatic-non marine saline and alkaline-hypersaline lake sediment sequence"
MAFHRSTQPTTSRVYRYGLLPPSSGANLVDEQMWLVHRYSNELVEIERARRKGFHAALAVVPEVAEALRVEEEALARYHVLRDSDSDDRAAEFRKKGKRRRKSSPAVADALAALKAATDAVEDVRAAAVKAIGRDSKKKTAKKKKKKKTATELVKMTPAEVASVTEAINENDAVHGDAAKRKRAEFIAQGLYWGNYQVAEASIPRKGPPPKFRRWEGRGHIAVQIQGGMTYAELLGCNHTMARLEIRDDWGSNRRTSRHGLLWIRVGSKGKGGREPVWATFPVCWHRHLPEGARIKRIDVTRRIQGVRAVWAVCVTVQTPGASLTKQALVKPTTEALPKAVGLDVGWRSTDDGGIRVAVLYDGDRHYEVALPHWFAEGDRLVSDLQSIRRCRFNAVKDQLLAALREGKHKEQAETFATLASWDSQARLARAVREWEGCPAYLTEWRAKERHLYQWERDAKRYLVEWRKNWYCHWVAWISQRYKNVVIEKFDIAKIKKKAEAGEDKEEATGPHSLAAPGELRRILLSTCSREGVQVHLAPAGNTTRKCSVCGKLRRKKKGEGVALMQECPGCGRVMDQDANAARNLYGFASVGVIPETPVAFAVPEAAWYGRFSLTPKKIQSRVARLQAALETSPPDSDGKGG

SEQ ID NO: 149 - protein, 640 aa, Unknown
  source: /note="Description of Unknown: aquatic-non marine saline and alkaline-hypersaline lake sediment sequence"
MRVYKYGLPWLLDEEEAPDGAKGGRMAVERQLRAAHVYQNKLIELIRARRLVHRDAVMGYGRVAELHKQVDDINELYQDARDDLKKTRQKERRRAESDRQKAMVAKLRELYKESLAQLYKERRKAFRDSAVKELCKEADESFYEQQRQERTRDLTDEERQRGWERPFWGTKQIVEASVKQAHESMPLWDGVRPNDPRFRSWDGSGILGVQNQRPLFSTLNDEQQMDPAVQDIFGKDTSLRVDPVDPEAWHNPKRCERKRKSRTVLWMRVGSDENRQPVWACWRMIMHRPLPDGAQIKRASVSKRIVGERQKWTVQIYVDDQGCKRAPSCGDGSVTIDLGWRQQQNGVRIATWLGSDGRQGKFKLPQKVIERMFSERGIRKTRDENLDRMRPCLEAWIRNQKCLPEWLEKRTKMIGRWRSHARFRALAQYWRGCRFPGDEEGYDMLEAWRYRDHHLWNYERGRSMKSRGWRDQLYCQFGAWLARQYGTVVWENFNIAKMAKRPKLGDDYENERARAMRHAVAVATFRDKVENAFDTRGGRSRYVSAVNTTRRCHVCGLVDAFDAASSVKRVPPCPGCGASWDQDENACVNMMETYDRGDSSSKPRKTNGARNGKKTNGNAVEGESHWARMKRLKREKDAHK

SEQ ID NO: 150 - protein, 549 aa, Unknown
  source: /note="Description of Unknown: aquatic-non marine saline and alkaline-hypersaline lake sediment sequence"
MFGHASDPSVIYRYGALPPTHNLDAAFEQLRAAHRYRNKLVEIERDRRDKTAAVVSAASPDLAGLESQYAELGERTAAAAKQIKATNQRARAQRATPEQKAVLRKLRAECKDVYSRLKEAKALAYKSLEARTALDQADAAALNAAKKARAECECYWGTYLQVEQGLSGIRKGAPPRFLRWTGNGKLAVQIQGGMSREEAEHGDGRLRIATTERRGKATNVYLRIGTNEDRSPIWAVVPVIFHRPIPDDARIKWVYLTARRVACHTRWHVCFVLSRAEGWRKPDLATIGTVAVDLGWRLLDHGLRVGYWRGSDGGSEEILLPTRDVARWQKADDLRAIRGERFNGVVDWLAKWLAGRDLPDWLIERTRTLRQWRSAARLASVVIHWRENRFAGDKDGFAAVEAWRKKDKHLYEWEANQRRKAVAWRDDLYRRVAADLSRRYKTAIVEDCNWRDVGRKPDVGENNDSGAAARQRTIAAPGRLKQLLVERFAETVKAEAAYTTQRCHACGELAHVETRTSVWVTCQQCGAAWDQDDNACRNMLDMVAKGPVT

SEQ ID NO: 151 - protein, 584 aa, Unknown
  source: /note="Description of Unknown: aquatic-non marine saline and alkaline-hypersaline lake sediment sequence"
MVDDQMRLGNRYYNRLIEIECARRDAIREAMADNDRRHGLSDAIARHARLDEQYNAAKEALKAKRSRARCRVDTAPERAAVRDLRAQRSKAAAELKEARKGHRGDSTMHAAFDAANEEAKLQRRASRAICGVYWGTYLQIEAAVDQAAKETSLFFKGKPRDPRFRRWGGSVMVATQLQGGLLALSALACDDSRLQIEMAELGPGPHSRRQLKLRKGTLRLRVGSDGRSPIWAEWPLQMHRPLPENGVIKWAKVIRRMVSDRDKWELQLTVEISPEQPCHGEGTVAVDLGWRRKEDGTIRVGYVVDDCGLEEEIILDPGVVSGLRKSEDLRSIQDKAQAEMAARVIGWLKAQAELPPWLILATGFVDKWKSARRWRRLASIWAEHPDVGSEALSVLSAWAADSLHLWRWEAHQRRKSCLRRKDQYRCLAKRLAAEYRHLVLESKFLAKLQRHVEAEDEDVEIKAVRLQQRDAAGYELKQCLIYAFRRANGTAVEVDPAMTPQRCNACGFVGRWDAAVEIDHTCEACGATWDQDANACRNLLERERPGDDSGQEAKRQGKWARKKAAKRTARKTVPSGAESFEAGV

SEQ ID NO: 152 - protein, 601 aa, Unknown
  source: /note="Description of Unknown: aquatic-non marine saline and alkaline-hypersaline lake sediment sequence"
MIRVYRYGLRRPTTNADLVDDQMRLGNRYYNRLIEIECARRDAIREAMADNDRRHGLSDAIARHARLDEQYNAAKEALKAKRSRARCRVDTAPERAAVRDLRAQRSKAAAELKEARKGHRGDSTMHAAFDAANEEAKLQRRASRAICGVYWGTYLQIEAAVDQAAKETSLFFKGKPRDPRFRRWGGSVMVATQLQGGLLALSALACDDSRLQIEMAELGPGPHSRRQLKLRKGTLRLRVGSDGRSPIWAEWPLQMHRPLPENGVIKWAKVIRRMVSDRDKWELQLTVEISPEQPCHGEGTVAVDLGWRRKEDGTIRVGYVVDDCGLEEEIILDPGVVSGLRKSEDLRSIQDKAQAEMAARVIGWLKAQAELPPWLILATGFVDKWKSARRWRRLASIWAEHPDVGSEALSVLSAWAADSLHLWRWEAHQRRKSCLRRKDQYRCLAKRLAAEYRHLVLESKFLAKLQRHVEAEDEDVEIKAVRLQQRDAAGYELKQCLIYAFRRANGTAVEVDPAMTPQRCNACGFVGRWDAAVEIDHTCEACGATWDQDANACRNLLERERPGDDSGQEAKRQGKWARKKAAKRTARKTVPSGAESFEAGV

SEQ ID NO: 153 - protein, 580 aa, Unknown
  source: /note="Description of Unknown: aquatic-non marine saline and alkaline-hypersaline mat sequence"
MARKTSKTPTKIYSYGARLDEGDMATARHILWMAQDYYDDRVRIEQARRLAYREARAQVCPWLRDAEVKIDLLELDLEKVREELKSKRKSEFRRATGTDLATMAKELLALLKPMRKEARAQRKAASADPGVQAEGQRLDLLAKTLLKSCSKYYGAKGLDWRTRGRVDDETRQAFADTASRPWRLGQCKKGFCGRVGGQVLAARGVFLDTDRLFSDWSTVVQIDPLPDHTWDTRSGRRKAITAGRISVGSLGPRRPVWLRFTAVIHRRPPRGIIKNAWLFFRERGGRVEAKFQFTLESEEFLRASPEPVHACAIAMTPSRNLSAAVAVGTDGTIQYLSLPEKVWDRFEFAESIRSAADLAFDEVRPSLVEAGLIPHQSRSRRRARRAAMGYAREALDAKAVWSTWRDERLGDGVDLWDSPDVVTDWAGRKGHDPLAVLCLVWSKKDGHLDRYEDNVRHKARGYRSETYRTWVSALASKYRLFVDPYDAKYLKHAPNPEDDPRIANIERARSRMSLYSLMTTLREKGATEVEADAVEPGAAAHVMRAASVLAKAGEDTTKAVAKIEESRRMVEMARQLDAAE

SEQ ID NO: 154 - protein, 635 aa, Unknown
  source: /note="Description of Unknown: aquatic-non marine saline and alkaline-saline lake sequence"
MAKVAKGEKMTFVYEYGLRPPSLNADIVDNQLILGNRYRNALVSIERKRRDAIRGWINKPVEKESIAYSEAIESFSIAETAMKKQRASTRSRSDTADQRDEVKDLRKKKKDALSVLKAARVKAKKEELFKAEMDDVENQSKQEIKDARSECGLYWGTYLVIEAAMAASRKKMPLWDKHFEPANPRYQRWQGTGTVAVQVQKSQQTTADHTMECTGRLIQLDMEKISDEERSKMSKRRQKRCFGTLRMRVGSEGRDPIWAEWPIIMHRPLPSDSTITEVRVIKKKISDHGKWNVHITIKTPDGYYKQHNGVDDKCGSGPLALDLGWRLLGTGELRVAYTTDEDGTEEEIRLDHNILTGLKKSDELQGLCDDLQNKMKSTLNEWKKTHHLPDWFAEESSHIHAWKKTHKFVRLLHSWSKNRWDGDSEGFDILNDWHFGAYKEDLGRRDGGSRHLWQWREHQRKKSLLRRKDQYRVLAARLSRKYSVLILEDLNLSKLQEHNKSEDDAVEIKEARWQQRAAACYELRECLKQAFLSRGGRVLKVKAAMTTQRCFCCGCEKKWDPIPSINHTCDQCGKTWDQDANAAKNIMLLYDKKEFSEQSSGVKKEDAESLSKWGKIGRHKKTSLKLTDNQPEQLN

SEQ ID NO: 155 - protein, 635 aa, Unknown
  source: /note="Description of Unknown: aquatic-non marine saline and alkaline-saline lake sequence"
MAKVAKGEKMTFVYEYGLRPPSLNADIVDNQLILGNRYRNALVSIERKRRDAIRGWINKPVEKESIAYSEAIESFSIAETAMKKQRASTRSRSDTADQRDEVKDLRKKKKDALSVLKAARVKAKKEELFKAEMDDVENQSKQEIKDARSECGLYWGTYLVIEAAMAASRKKMPLWDKHFEPANPRYQRWQGTGTVAVQVQKSQQTTADHTMECTGRLIQLDMEKISDEERSKMSKRRQKRCFGTLRMRVGSEGRDPIWAEWPIIMHRPLPSDSTITEVRVIKKKISDHDKWNVHITIKTPDGYYKQHNGVDDKCGSGPLALDLGWRLLGTGELRVAYTTDEDGTEEEIRLDHNILTGLKKSDELQGLCDDLQNKMKSTLNEWKKTHHLPDWFAEESSHIHAWKKTHKFVRLLHSWSKNRWDGDSEGFDILNDWHFGAYKEDLGRRDGGSRHLWQWREHQRKKSLLRRKDQYRVLAARLSRKYSVLILEDLNLSKLQEHNKSEDDAVEIKEARWQQRAAACYELRECLKQAFLSRGGRVLKVKAAMTTQRCFCCGCEKKWDPIPSINHTCDQCGKTWDQDANAAKNIMLLYDKKEFSEQSSGVKKEDAESLSKWGKIGRHKKTSLKLTDNQPEQLN

SEQ ID NO: 156 - protein, 631 aa, Unknown
  source: /note="Description of Unknown: aquatic-sediment-groundwater sediment sequence"
MKRKTSTTPTRIWSFGALEPTENQKALLDQLFFANRYYNTLIEIERKRRNRFREIRSEAVPELSMLEKRYQQLDADYVQMVAALPKPEKGKRKTLTPEVLANKEERKTTSARMKVLRAAFLEDADAKIQTAKADEEAQLAVKAARAATDLYWGTYLLIERQVDEARKSKSDPDFRRFDGQGRVGVQLQGGLSTPELLSGEDSRLRLQPRTSTPRVKKPKAQHEVRIRIGSLGRDPIWATLPVIVHRPLPEDAEVKWAWVRIVRCGRRRIYSLQLTLESATFDRSQSGVGTVAINFGWRANEDGSRRVAYAVDDAGKEQVLSIPASIEKDTTQANSLRSLRDLHFEEAKRSLVAFAALHPKAMPEWYAEEAKFLHQWRNPARLVRLAQRLAEEHPVDSNELLRWRQERLGGARFGRHWRSPGAPKQDLFAPFPEVMSWSTTRGIGALNFYLELWARKDKHLWGWEASLRRSVDLRRNDLFRTWAKRMTAYAEVRVEEFDLRKMTAIPAVGEEPRDSSFRSAQRAASPGKLRERIAEACGAKVMKGAAFHNTVTCFLCSHVNERSMEHRTVCAGCGEEFDQDANNCRNQLRERPSGAPEAGGARNPQKDPVVSDGYDESTVDRDVPSGVVAAE

SEQ ID NO: 157 - protein, 553 aa, Unknown
  source: /note="Description of Unknown: aquatic-sediment-groundwater sediment sequence"
MKRASREAGQVVVYRYGCPSWADLPESGMVQLRLAHDLRNELVAVEYRYRELIDGIWSSQSAVSVAELALADATAAVERAAALMLAQRKIDRSTIPRAGAKQALAEARAARREAKLTVKVAKAIDKEAAGPLLADAKAARYAAITSTRAEYVVAGLFWATANDVVQNHDTAAKLVALAWKQGRPARRRTRPWKGTGTITTQVMWQAGKPARTPGVLASATSPWRNVFRIEPGRSRGEWPGQPSSGGTVRDDHATVHLRIEKGAEAICLPIVLHRPLPTDGDVAGVQITRRRIAGCYRLSIAITVRLPEPTPALGGVPVSVTFGWAAAGDGAVHVARLGAPFGLGPPPPWLVKHLVAIPASATDVDVFAPAIWRLLLARDDSIRGHRDDLLDGLREQVITALDEGVEVRLWPDDEDLLRSPVVARWRAPRRFVTLARAWPVEHPMAAMLEAWRLRDRHLWEYESHERDQVIARRRDAYRSVAAWICGQASEILLDYPPVAELRQVPDVNEEDEYVARAGRRQVQFAAPGDLRAAIEVAARRRGVKVIDVRVPPE

SEQ ID NO: 158 - protein, 625 aa, Unknown
  source: /note="Description of Unknown: aquatic-thermal springs-hot spring sequence"
MRVYRYGAKLRGPLDPVAEEQVELANRFWNELVDMHRKYGELLQKAQEEASPALAALRAEMAALAEEKIRLRGLIKKSRQKARGNVPADPAIKEQLRAVSQRIKELKPIVKMEKEKAKTASSDERHRLSEQQKLEKKRLRQKYAALGLYWSNYNAVLQGFDTAVKRELETQGRLRVRKHAPSGAAVWTVRIQHPTGAREYTWADATRGDPSKPFSIIMPDSEREEFTTHDGRTLSRRRLPVARLRVRAERAKTPDGTWVEFGGHHIDVPFYMHRQPPPTARVVMARLVRKRIADCYEYHLCITVDEPPAPKRSGTAAGVDLGWRRLPDGAVRVAYVAGEDGAKGALAVPQSTLDRLAHAERLQGIRDSALEGIRSDFVAWAKPLLGNPALPDFVAAALAGDREHGIPPLASWRSPRRFARLTGQLVRWAADHPNQAAALPDWPAWNRRIQSWNRQDKPLWRTLSFLRVKAIAHRNEQYRIFAKRLAERYAYIVLEDMDIQDMNRKPQAEQAPETSQQKLRHLARAAAPAAVRSAIENASWRWGSTFVKVDPANTTRRHAPCGNLVEQNYAESVMVYCPECKVWYDQDENAAVNLLLRIRENPPPAPTNPKPANGSRWQRAKAKAR

SEQ ID NO: 159 - protein, 649 aa, Unknown
  source: /note="Description of Unknown: aquatic-thermal springs-hot spring sequence"
MGPPAEAPGPRRDTAHSTEEEIASMRVYRYGAKLRGPLDPVAEEQVELANRFWNELVDMHRKYGELLQKAQEEASPALAALRAEMAALAEEKIRLRGLIKKSRQKARGNVPADPAIKEQLRAVSQRIKELKPIVKMEKEKAKTASSDERHRLSEQQKLEKKRLRQKYAALGLYWSNYNAVLQGFDTAVKRELETQGRLRVRKHAPSGAAVWTVRIQHPTGAREYTWADATRGDPSKPFSIIMPDSEREEFTTHDGRTLSRRRLPVARLRVRAERAKTPDGTWVEFGGHHIDVPFYMHRQPPPTARVVMARLVRKRIADCYEYHLCITVDEPPAPKRSGTAAGVDLGWRRLPDGAVRVAYVAGEDGAKGALAVPQSTLDRLAHAERLQGIRDSALEGIRSDFVAWAKPLLGNPALPDFVAAALAGDREHGIPPLASWRSPRRFARLTGQLVRWAADHPNQAAALPDWPAWNRRIQSWNRQDKPLWRTLSFLRVKAIAHRNEQYRIFAKRLAERYAYIVLEDMDIQDMNRKPQAEQAPETSQQKLRHLARAAAPAAVRSAIENASWRWGSTFVKVDPANTTRRHAPCGNLVEQNYAESVMVYCPECKVWYDQDENAAVNLLLRIRENPPPAPTNPKPANGSRWQRAKAKAR

SEQ ID NO: 160 - protein, 598 aa, Unknown
  source: /note="Description of Unknown: aquatic-thermal springs-hot spring sequence"
MRQLRVAHEVYNTLVQYERERRKAVADATRETDAEVARLEAEVEGLLSRLADLRAAIQAARAGGGDNARLAEAQAEARECRRLLGEAKGALRETKRVARQNPALRERLEAIKAEHHRRQLALYHEVVEVGKRLYWPSWNDTKAAVEQAAKKTKNGDLRFRRWTGEGSLYTQVQGKQPVCETATSRWVRIDPVPPEAHDPATPRGERRRLCRTRFYLRIGSTGPREDPVFAVFPMVYHRPLPEGAVICGARIVRRKNADREYWQAVVTVDLPDEAAQKSGPRVCALDIGWRDRRPGGSDEPPPLRVAAWYDGDRTGEVLVDPSVFERCAKADAIRSTRDRMLDDLRAWLCEARKDLPEHLAEALAGCGLWRAAGKFARLRGLLSSGDVPAEVRDRFLAWYHRDRHLWQYEHGMRLNAIRDRDNAYRIAAKRFAQEYDVLIVEATGTPQKERDPKAPAAMDLRPLIKEPDPEDAPPRDQQRERKENKAHHQRFIAAAGTFRRYLLEAAAKYGTRVVMVPCEQTTLECWVCGAKYEFDRWPLMHECESCGTTWDQDQNAARNLFARGAVAAKGPGPLEVQGKPRLPRWHKRHKAYREGGAG

SEQ ID NO: 161 - protein, 618 aa, Unknown
  source: /note="Description of Unknown: aquatic-thermal springs-hot spring sequence"
MATRNCRYGLLAPVEGRDEVMRQLRVAHEVYNTLVQYERERRKAVADATRETDAEVARLEAEVEGLLSRLADLRAAIQAARAGGGDNARLAEAQAEARECRRLLGEAKGALRETKRVARQNPALRERLEAIKAEHHRRQLALYHEVVEVGKRLYWPSWNDTKAAVEQAAKKTKNGDLRFRRWTGEGSLYTQVQGKQPVCETATSRWVRIDPVPPEAHDPATPRGERRRLCRTRFYLRIGSTGPREDPVFAVFPMVYHRPLPEGAVICGARIVRRKNADREYWQAVVTVDLPDEAAQKSGPRVCALDIGWRDRRPGGSDEPPPLRVAAWYDGDRTGEVLVDPSVFERCAKADAIRSTRDRMLDDLRAWLCEARKDLPEHLAEALAGCGLWRAAGKFARLRGLLSSGDVPAEVRDRFLAWYHRDRHLWQYEHGMRLNAIRDRDNAYRIAAKRFAQEYDVLIVEATGTPQKERDPKAPAAMDLRPLIKEPDPEDAPPRDQQRERKENKAHHQRFIAAAGTFRRYLLEAAAKYGTRVVMVPCEQTTLECWVCGAKYEFDRWPLMHECESCGTTWDQDQNAARNLFARGAVAAKGPGPLEVQGKPRLPRWHKRHKAYREGGAG

SEQ ID NO: 162 - protein, 572 aa, Unknown
  source: /note="Description of Unknown: aquatic-thermal springs-hot spring sediment sequence"
MFGHESLPSRIYSYGTMKLGDFPGRDKAEEQMRLAHRYRNRLVEIELARRRAVEEALRRLSPDLVGCELAIEAQERALEVARSSIRRASAEARKKVASPEARDAAKTAIAHLKRERAKRMSLRKALFSSSDWEAEEKRISDEAGAAIRKARAECGLYWGTYLHVEGTVKRTGAPPRFHRWDGSGHLAVQIQHGMTWAEALAGADNRLRVRHAPPTNSKHSQLLHVVSVRVGSTEDGFPVWADVPRVVLHRPIPDGARIKWVHLIRRRIGCSQKWHVQFVVSAESWERTDRATSGTVGINVGWRMRPDGSLRVAAFCGDDGRRGELCLPSRWLAQWKKTEDIRSIRDRNFDDVRTAIANWVKGTIPEHVRALTGEVMPELPPWWRQRAATLASWKSPARLAALTLHWRANRFAGDAVMFPLVEDWRRRDRHLYEYERHLADQLLAEREDLYRVFAADLRRRYKTAIVMELDLRDFHVLPPAEEPTPDGALREHTRDACLSLLHRCLDESMSEVIRSDPRNVTRMCRECGGLNDWDRKVLHRVCSWCHAEWDQDENAARNLRDRTGGGASDKVA

SEQ ID NO: 163 - protein, 580 aa, Unknown
  source: /note="Description of Unknown: aquatic-thermal springs-hypersaline mat sequence"
MPFGKKRSDKVAIVYEYGCLPPEGGLPAVAERQLVLADDFWNSLADIDRRHRAKMREILDDGELGKLNAHITSCKARIEELRGQIKGVNQRERRNAGVDANTKAEIARLKAEVKATAARIKEIKPEHIAKQKPLLEENDALRQAAVKRARQWFSDRGLYWGTYNAVLRSYETAHKVLLKSGEQMQAHRYTGEGRWVVQIITTAGEKPTTAEDLATGTMVQIDPVDFSDWKHISRGERRRRARTKCRIRVGSEGRAPVWLELPCVMHRPLPEGAEIVGADVTRRLVGPARWEYRLHLTLRVPAPVPADAAKPAIGVDIGWRALPNGGTRVAYAVGEDGSRKEVVCPDDILAGLAKSSDLRSLRDEKMNRIKAFLRDVIPGLDSADLSEQTEHLAMWKSPKRLIRLYRWWKEHRVEGDTEAFGRLHEWYYHDYWHLYQYEDDMRQQVLARRRDMYRIAAKEIAERASVVVIEEFDLRKFAQEDQPEDGEDNKIQRARRVAVAPSEFRIALRQACAARGVRVVEKPAQNTTRVHVVCGQVVAADYAADVTVRCPRCGVAYDQDANAALNLLGAGRGESTPAAS

SEQ ID NO: 164 - protein, 619 aa, Unknown
  source: /note="Description of Unknown: arthropoda-digestive system-termite gut sequence"
MITVVQYGVWHKWMRDVPRDVMDQLWLSHCVREDFVSTTLAYDARLKEIWSSFPVVGEAECRLLEASDALDVLLEEQRVVRQSSRSKKVSADLRSRLADARGVVRAARVGRRDAIQVAKDAAMPLIVQAKDAQREARRGLYAKYCSYGVPDRDGRVIRLYHATFNDVRVMHEAAEKRLASSRKQGGRGQMRHHRFDGTGTLCVSLLRTAGDPPRTPMVVANSESGAYRNVLGVPWVAPVVWEGLSRSQRRADGRVGVRMRVGYGDDLKSPTHVDIPVQAHRFLPAEADITGAKLSIRRRGTKLIGSLSITAKDVPDPLPVKDGPSIVLHWGWRDVPTGGAEVARWVSTSPLDIPVDMRGVFTCHDESRMSGAVIAPAVMFTKLDHVEALQSELDTAFNEARGVLSEWLRAHPDVVVDDPTSREPVVLTGAVVGAWRSHERLARLAWAWHRECPAGVEDMESVLWEWRCGHRHVSNIAANTRARAINARRDVYRNVAAVISGQCGGVGVDDMDLARLASRGASSELPDTVTAPGSRRRVYAAPGELRYCIVSACQKDGVTVVTLDTAENSHTCHACGYANPGDDRWLNPMVLCDGCGKVFDQNTNALLNLVDKYTATLAV

SEQ ID NO: 165 - protein, 667 aa, Unknown
  source: /note="Description of Unknown: arthropoda-digestive system-termite gut sequence"
MVVAPPPVCDLRGNIPWILSWIIDEPAMLGMLLALYAGTLSEMIRVYRYGLLAPTMNGKLVKEQMRAAHRYRNALIEIECARRDALRRLLTESGLRELEEETAAANEAVHAAAAAAREARMTVQSKSEPIDARQRMRDAREVSRRALDALRVRRREVRENHAVQRAMDEINERAARLRRGARALCGVYWGTYLLVEDADHRARAAALYDGAQPNNPRCSRFVGAGRVGVQIQKGFPCETLFGSDARLRVAPVDSGAWHSMRRGERRQLSRTTLSLRIGSEGRDPIWAQWPMLMHRPLPEGSIVKRATVSVRRRGPRDEWAVEITVDVADEILAVQRTDSNESAVAIHIGWRAIGNELRVAAWAGSDGRSGELRLPASLLGAFAKVEELRSIRDRNLAAARDALSGWLAAAASIPEWLREATVGIMEWRVPSRLAVLAKQWRNVRFVGDEKAYEALEAWRYHDYHLWSWEDSQRIHALRARRELYRIFAAQLAREYVSIVIEDFDLRVVAKRHLVEDASIEWRGLRRNRQAAAVSELRASLQNASKSRSARIELLDTRSFLQPCHACGSKERFDSVEPLDHSCSGCGAIWDRDSNAALVLLQRWRREHACGGEVAHADVDTKPVPEGRWVRARRHRAEKDAHARFGASDNSEWFGNGNASVISIESPS

SEQ ID NO: 166 - protein, 618 aa, Unknown
  source: /note="Description of Unknown: arthropoda-digestive system-termite gut sequence"
MITVIKYGVWHTWSRHIPDSVRDQLWLAHCAREDLVTTTLDYHDALKDIWSSFPEVAAAEQRIRDADDLLATLLDEQSKARQASQSKKVPTDLRQRLTQARASVRSAKQERRDAITTAGVIATPLIAQAKDAQYARRKELYTTYCTRGIPDRDGRIVRLYHATFNDVRTSHETAEKRISASRANGSPAQMRHHRFDETGTLAVSLLRQAGAPPRTPQVLADTETGKYRNVLAMPWFTPDAWAGKTRAQQRVDGRVTLRMRIGYADDLSSPTFVDLPVQAHRFFPPEADITGAKLTIQRRGTTFHATVSITGKGLPDPTPVTSGPAVVLHWGWREVDTDIVEVARWAADAPLHIPDDMGDVFTTDGSGTGGSILTPKTVFTRLNHVEKLQSEQGTAFSSAKNALVSWLSTHATPMGDPTSKQPQPLAPALVDAWRSPDRLARLAWLWRDDRPDGADDLTADLLAWRGAYRHTATLIANTRAKAISHRNDVYRNVAAVISGQAATVGLDSMDLATIAATSARSELSGDVTQPGARRRTYAAPGTLREYIAAACAKDGVTVSSLDSSHASRTHYECGHTNPRDTKWLNPIVRCDGCGESFDQNTNALHHLQARQRDLSLTA

SEQ ID NO: 167 - protein, 584 aa, Unknown
  source: /note="Description of Unknown: groundwater metagenome sequence"
MPFGRKAKPCRVFEYGCLPPVSGKDELLKELRLRNNYWNKLVEIDRLIRQRSALILLLPGDIEAAHLDAQIDLMRGEIKKGRQRTRSSITDADLKQRIKDSIAELRVLWEQNKKDRKPLIETTRADLAAIETEWRVARKAARADSGLYWCNYDDVDTAYDVARKETAKKWAFPKFRRFDGTGKVTVRWQNGLNANNVFDGTGTLLQIAPVHQDAWNHPVRSNRRKASRTTVRFRVRSENRSPVWVELPMVMHRPLPAGGEIRSASLVCGYVGGKPTYKLVITVAPPAHTLPEEGMHRGIRPTVGINLGWRKKDNDIRIAYWADEEGRHGELTLTSNTLAQFSKLNDLKSIRDKYFNEAISALALYISEGTIPDWLKADTTHLNKWRSKPRLLALVGKWRETRFTGDEIIYEALFYWRGRELHLHQWEANLRDQVQRHRRERYRIFAAQLAKDYSQIFIENHNLVVTKKKKATEDGTYLTTEVDTLRTIASPGILRGQIENACRREGVIFTKLDAKHITSKCHICGWQEKWNAAATITRECPGCKTEWDQDYNAARLLLQRGLDGGYLAVPQTTLEDDPNFCIGS

SEQ ID NO: 168 - protein, 567 aa, Unknown
  source: /note="Description of Unknown: human gut metagenome sequence"
MNKVSITKVFKYRCFEPVEGLALFDEALDNRHTLWNKLVEIDRDFREKSTQIITPIKSDYQVLDQEIKNLQDSIKAIKRKTRSTAKEETRNIQDTIKELKVKRKEAYQEFKRLKHEAIEREKPLLDCLNNERKEKVKQLRSESGLHGFNFDDVIHNIYDVARIKAMKQGTLLQFKRYSKNGKIAVRPYSSSPLYGSDIHRVNTIFYIEPVNQELYNSPIRGVRKKASVTRCHIRVGSADKGKPIFVTLPMVYHRPLPMDGKINAINVKRHYIDHKPIYECLITVTYAIEAPTINPNSCVAVDLGWRMTKDGLRAAYATDTDDKTIECIVTQRQLNEFDTICGLSSTRQKHLNDCIHVIKAWMANKNLPDWLTDAVAYIDKWKSYTHIFDLHSAFLQHKKSGNQEIVSYLEAYIERENHLRTWQSNLQNQVIARRNYEYQNFAAKLANMYDVLVLEKLSITNIVKHQKAIIGSQQSTAVDRNRTIVAPYVLKTILINAFRSRGKQFVEVNASYSTKVCHHCGALEEVHQSSIMHTCTQCHTVWDQDYNACINLLALYNHDNKGGVSCV

SEQ ID NO: 169 - protein, 563 aa, Unknown
  source: /note="Description of Unknown: human gut metagenome sequence"
MNKVSITKVFKYRCFEPVEGLSLFDEALDNRHMLWNKLVEIDRDFREKSSKIITPIQSDYQVLDQEIKNLQDAVKAIKCKTRSTAKEETRTIQDTIKELKVKRKEAYQEFKRLKHEAIEREKPLLDCLNNERKEKVKQLRSKSGLHGFNFDDVTHNIYEVARVKAMKQGTLLRFKRYSKNGKIAVRPYSNSPLYGSDIHRVNTIFYIDPVNQELYNSPIRGVRKKASVTQCHIRIGSAVKGKPIFVTLPMVYHRPLPMDGKINAINIKRHYIDQKPIYECFITVTYLIEAPAVNPNSCVAVDLGWRMTKDGLRAAYATDKDHKAIECIVTQRQLNEFDTIRGLSSTRQKHFNDCIHVIKAWIANKNLPDWLIDAVAYIDKWKSYTHIFKLYNAFLQHEKSGNQEIISYLEAYIERENHLRIWQSNLQDQAIAKRNYEYQNFAARLANMYDVLVLEKLSITDIVKYQKAIIGSQQSTALDRNRTIVAPYELKTILINAFTSRGKQFVEVNASYSTKVCHHCGALEEVHQSSIMHTCTQCHTVWDQDYNACINLLALYDNKVGAY

SEQ ID NO: 170 - protein, 567 aa, Unknown
  source: /note="Description of Unknown: human metagenome sequence"
MNKVSITKVFKYRCFEPVEGLALFDEALDNRHTLWNKLVEIDRDFREKSSQIITPIQSDYQVLDQEIKNLQDSIKAIKRKTRSTAKEETRNIQDTIKELKVKRKEAYQEFKRLKHEAIEREKPLLDCLNNERKEKVKQLRSESGLHGFNFDDVIHNIYDVARIKAMKQGTLLQFKRYSKNGKIAVRPYSSSPLYGSDIHRVNTIFYIEPVNQELYNSPIRGVRKKASVTRCHIRVGSADKGKPIFVTLPMVYHRPLPMDGKINAINVKRHYFDHKPIYECLITVTYAIEAPTINPNSCVAVDLGWRMTKDGLRAAYATDTDDKTIECIVTQRQLNEFDTICGLSSTRQKHLNDCIHVIKAWMANKNLPDWLTDAVAYIDKWKSYTHIFDLHSAFLQHKKSGNQEIVSYLEAYIERENHLRTWQSNLQNQVIARRNYEYQNFAAKLANMYDVLVLEKLSITDIVKHQKAMIGSQQSTALDRNRTIVAPYELKTILINAFTNRGKQFVEVNASYSTKVCHHCGALEEVHQSSIMHTCTQCHTVWDQDYNACINLLALYNHNNKVGVSCV

SEQ ID NO: 171 - protein, 567 aa, Unknown
  source: /note="Description of Unknown: human metagenome sequence"
MNKVSITKVFKYRCFEPVEGLALFDEALDNRHMLWNKLVEIDRNFREKSSQIITPIQSDYQVLDQKIKNLQDSIKAIKRKTRSTAKEETRNIQDTIKELKVKRKEAYQEFKRLKHEAIEREKPLLDCLNNERKEQVKQLRSKSGLHGFNFDDVIHNIYDVARVKAMKQGTLLRFKRYSKNGKIAVRPYSNSPLYGADIHKVNTIFYIEPVNQELYNSPIRGVRKKASVTQCHIRVGSADKGKPIFVTLPMVYHRPLPMDGKINAINVKRHYIDHKPIYECLITVTYVIEAPAVNPSSCVAVDLGWRMTKDGLRAAYATDKDNKTMECIVAQRQLNEFDTIRGLSSTRQKHFNDCIHVIKAWIANKNLPDWLIDAVAYIDKWKSYTHIFELYNAFLQHEKSGNQEIVSYLEAYIERENHLRIWQSNLQDQVIAKRNYEYQNFAAKLANMYDVLVIEKLSITDIVKHQKAIIGSQQSTALDRNRTIVAPYVLKTILINAFTSRGKQFVEVNASYSTKVCHHCGALEEVHQSSIMHTCTQCHTIWDQDYNACINLLTLYNHDNKVGVSCV

SEQ ID NO: 172 - protein, 567 aa, Unknown
  source: /note="Description of Unknown: human metagenome sequence"
MNKVSITKVFKYRCFEPVEGLALFDEALDNRHTLWNKLVEIDRNFREKSSQIITPIQSDYQVLDQEIKNLQDSIKAIKRKTRSTAKEETRNIQDTIKELKVKRKEAYQEFKRLKHEAIEREKPLLDCLNNERKEKVKQLRSESGLHGFNFDDVIHNIYDVARIKAMKQGTLLQFKRYSKNGKIAVRPYSSSPLYGSDIHRVNTIFYIEPVNQELYNSPIRGVRKKASVTRCHIRVGSADKGKPIFVTLPMVYHRPLPMDGKINAINVKRHYIDHKPIYECLITVTYAIEAPTINPNSCVAVDLGWRMTKDGLRAAYATDTDDKTIECIVTQRQLNEFDTICGLSSTRQKHLNDCIHVIKAWMANKNLPDWLTDAVAYIDKWKSYTHIFDLHSAFLQHKKSGNQEIVSYLEAYIERENHLRTWQSNLQNQVIARRNYEYQNFASKLANMYDVLVLEKLSITDIVKHQKAMIGSQQSTALDRNRTIVAPYELKTILINAFTNRGKQFVEVNASYSTKVCHHCGALEEVHQSSIMHTCTQCHTVWDQDYNACINLLALYNHNNKVGVSCV

SEQ ID NO: 173 - protein, 567 aa, Unknown
  source: /note="Description of Unknown: human metagenome sequence"
MNKVSITKVFKYRCFEPVEGLALFDEALDNRHMLWNKLVEIDRNFREKSSQIITPIQSDYQVLDQKIKNLQDSIKAIKRKTRSTAKEETRNIQDTIKELKVKRKEAYQEFKRLKHEAIEREKPLLDCLNNERKEQVKQLRSKSGLHGFNFDDVIHNIYDVARVKAMKQGTLLRFKRYSKNGKIAVRPYSNSPLYGADIHKVNTIFYIEPVNQELYNSPIRGVRKKASVTQCHIRVGSADKGKPIFVTLPMVYHRPLPMDGKINAINVKRHYIDHKPIYECLITVTYVIEAPAVNPSSCVAVDLGWRMTKDGLRAAYATDKDNKTMECIVAQRQLNEFDTIRGLSSTRQKHFNDCIHVIKAWIANKNLPDWLIDAVAYIDKWKSYTHIFELYNAFLQHEKSGNQEIVSYLEAYIERENHLRIWQSNLQDQVIAKRNYEYQNFAAKLANMYDVLVIEKLSITDIVKHQKAIIGSQQSTALDRNRTIVAPYVLKTILINAFTSRGKQFVEVNASYSTKVCHHCGALEEVHQSSIMHTCTQCHTIWDQDYNACINLLALYNHDNKVGVSCV

SEQ ID NO: 174 - protein, 492 aa, Unknown
  source: /note="Description of Unknown: marine sediment metagenome sequence"
MNLGRVYYNSLVEAENERRTTMWGGDRPPSPATHVCKKSCSTCDKAESKKRKPRKHECKKFCPVCRAHYKALRKQYRSEPPLDVKPFRKKAAEGGLYWGTYLVIEQDFSAAWKETESFSLVKFRSWRQGDMCAVQIQRDKDPDRMFLIKSAPDPRKKKQQRYTLRLRVGSKGQAPVWAEPLPFEMHRPLQGTATWVKIARKYVADRVIWSVQFTRRDIPERKDNAERGAVAIDVGWRKTDDGMRIAYARGDDGAEYELVLPPKWMKHADQADRIRSARDQNLVELQKQERFWSVILAVCGFSNKKLFARLKSTLSVRRVAKPGEHTKWIKKERHLWQYEAGCRNRSVTRRRNDVRVWLRDLRRRYAHAVIKDSCHKKMKENKTSLPKPARRQGHHAAPGEVIEEITRVFGRITGVSVVCAVDTTNHCPACSFVNSYGPERVVTCGGCGVVEDRDRVSTQNMMNMYAIGNVRNPTTRKSTPRFAKKHKDPEAP

SEQ ID NO: 175 - protein, 511 aa, Unknown
  source: /note="Description of Unknown: marine sediment metagenome sequence"
MTKVYKYGALPGGDTLCAQMNLGRVYYNSLVEAENERRTTMWGGDRPPSPATHVCKKSCSTCDKAESKKRKPRKHECKKFCPVCRAHYKALRKQYRSEPPLDVKPFRKKAAEGGLYWGTYLVIEQDFSAAWKETESFSLVKFRSWRQGDMCAVQIQRDKDPDRMFLIKSAPDPRKKKQQRYTLRLRVGSKGQAPVWAEPLPFEMHRPLQGTATWVKIARKYVADRVIWSVQFTRRDIPERKDNAERGAVAIDVGWRKTDDGMRIAYARGDDGAEYELVLPPKWMKHADQADRIRSARDQNLVELQKQERFWSVILAVCGFSNKKLFARLKSTLSVRRVAKPGEHTKWIKKERHLWQYEAGCRNRSVTRRRNDVRVWLRDLRRRYAHAVIKDSCHKKMKENKTSLPKPARRQGHHAAPGEVIEEITRVFGRITGVSVVCAVDTTNHCPACSFVNSYGPERVVTCGGCGVVEDRDRVSTQNMMNMYAIGNVRNPTTRKSTPRFAKKHKDPEAP

SEQ ID NO: 176 - protein, 567 aa, Unknown
  source: /note="Description of Unknown: metagenome sequence"
MNKVSITKVFKYRCFEPVEGLALFDEALDNRHTLWNQLVEIDRNFREKSSQIITPIQSDYQVLDQEIKNLQDSIKAIKRKTRSTAKEETRIIKDTIKELKVKRKEAYQEFKRLKHEAIEREKPLLDCLNNERKEQVKQLRSKSGLHGFNFDDVIHNIYDVARVKAMKQGTLLRFKRYSKNGKIAVRPYSNSPLYGADIHKVNTIFYIEPVNQELYNSPIRGVRKKASVTQCHIRVGSADKGKPIFVTLPMVYHRPLPMDGKINAINVKRHYIDHKPIYECLITVTYVIEAPAVNPSSCVAVDLGWRMTKDGLRAAYATDKDNKTMECIVAQRQLNEFDTIRGLSSTRQKHFNDCIHVIKAWIANKNLPDWLIDAVAYIDKWKSYTHIFELYNAFLQHEKSGNQEIVSYLEAYIERENHLRIWQSNLQDQVIAKRNYEYQNFAAKLANMYDVLVIEKLSITDIVKHQKAIIGSQQSTALDRNRTIVAPYVLKTILINAFTSRGKQFVEVNASYSTKVCHHCGALEEVHQSSIMHTCTQCHTIWDQDYNACINLLALYNHDNKVGVSCV

SEQ ID NO: 177 - protein, 567 aa, Unknown
  source: /note="Description of Unknown: metagenome sequence"
MNKVSITKVFKYRCFEPVEGLALFDEALDNRHTLWNKLVEIDRDFREKSSQIITPIQSDYQVLDQEIKNLQDSIKAIKRKTRSTAKEETRNIQDTIKELKVKRKEAYQEFKRLKHEAIEREKPLLDCLNNERKEKVKQLRSESGLHGFNFDDVIHNIYDVARIKAMKQGTLLQFKRYSKNGKIAVRPYSSSPLYGSDIHRANTIFYIEPVNQELYNSSIRGVRKKASVTRCHIRVGSADKGKPIFVTLPMVYHRPLPMDGKINAINVKRHYIDHKPIYECLITVTYAIEAPTINPNSCVAVDLGWRMTKDGLRAAYATDTDDKTIECIVTQRQLNEFDTIRGLSSTRQKHFNDCIHVIKAWMANKNLPDWLTDAVTYIDKWKSYKHIFELHDAFLQHKKSGNQEIVSYLEAYIERENHLRTWQSNLQDQVIARRNYEYQNFAAKLANMYDVLVLEKLSITDIVKHQKAIIGSQQSTALDRNRTIVAPYELKKILINAFTNRGKQFVEVNASYSTKVCHHCGALEEVHQSSIMHTCTQCHTVWDQDYNACINLLALYNHDNKVGVSYV

SEQ ID NO: 178 - protein, 567 aa, Unknown
  source: /note="Description of Unknown: metagenome sequence"
MNKVSITKVFKYRCFEPFEGLELFNEALDNRHTLWNKLVEIDRDFREKSSQIITPIQSEYQILDQEIKNLQDSIKAIKRETRSTAKEETRNIQDTIKELKVKRKEAYQEFKRLKHEAIEREKPLLDCLNNERKEKVKQLRSESGLHGFNFDDVIHNIYDVARIKAMKQGTLLQFKRYSKNGKIAVRPYSSSPLYGSDIHRVNTIFYIEPVNQELYNSSIRGVRKKASVTRCHIRVGSADKGKPIFVTLPMVYHRPLPMDGKINAINVKRHYIDHKPIYECLITVTYAIEAPTINPNSCVAVDLGWRMTKDGLRAAYATDTDDKTIECIVTQRQLNEFDTIRGLSSTRQKHFNDCIHVIKAWMANKNLPDWLTDAVAYIDKWKSYKHIFDLYDAFLQHKKSGNQEIVSYLEAYIERENHLRTWQSNLQDQVIARRNYEYQNFAAKLANMYDVLVLEKLSITDIVKHQKAIIGSQQSTALDRNRTIVAPYELKTILINAFTNRGKQFVEVNASYSTKVCHHCGALEEVHQSSIMHTCTQCHTVWDQDYNACINLLALYNHDNKVGVSYV

SEQ ID NO: 179 - protein, 567 aa, Unknown
  source: /note="Description of Unknown: metagenome sequence"
MNKVSITKVFKYRCFEPVEGLALFDEALDNRHTLWNKLVEIDRDFREKSTQIITPIQSDYQVLDQEIKNLQDSIKAIKRKTRSTAKEETRNIQDTIKELKVKRKEAYQEFKRLKHEAIEREKPLLDCLNNERKETVKQLRSESGLHGFNFDDVIHNIYDVARIKAMKQGTLLQFKRYSKNGKIAVRPYSSSPLYGSDIHRINTIFYIEPVNQELYNSSIRGIRKKASVTRCHIRVGSADKGKPIFVTLPMVYHRPLPMDGKINAINVKRHYIDHKPIYECLITVTYAIEAPTINPNSCVAVDLGWRMTKDGLRAAYATDTDDKTIECIVTQRQLNEFDTIRGLSSTRQKHFNDCIHVIKAWMANKNLPDWLTDAVAYIDKWKSYKHIFDLYDAFLQHKKSGNQEIVSYLESYIERENHLRTWQSNLQVQVIARRNYEYQNFAAKLANMYDVLVLEKLSITDIVKHQKAIIGSQQSTALDRNRTIVAPYELKKILINAFTNRGKQFVEVNASYSTKVCHHCGALEEVHQSSIMHTCTQCHTVWDQDYNACINLLALYNHDNKVGVSNV

SEQ ID NO: 180 - protein, 567 aa, Unknown
  source: /note="Description of Unknown: metagenome sequence"
MNKVSITKVFKYRCFEPVEGLALFDEALDNRHTLWNKLVEIDRDFREKSSQIITPIQSDYQVLDQEIKSLQDSIKAIKRKTRSTAKEETRNIQDTIKELKVKRKEAYQEFKRLKHEAIEREKPLLDCLNHERKEKVKQLRSESGLHGFNFDDVIHNIYDVARIKAMKQGTLLRFKRYSKNGKIAVRPYSSSPLYGSDIHRVNTIFYIEPVNQELYNSSIRGVRKKASVTRCHIRVGSADKGKPIFVTLPMVYHRPLPMDGKINAINVKRHYIDHKPIYECLITVTYAIKSPAVNPDSCVAVDLGWRMTKDGLRAAYATDTDNKTMECIVAQRQLNEFDTIRGLSSTRQKHFNDCIHVIKAWMANKNLPDWLTDAVAYIDKWKSYKHIFDLYDAFLQHKKSGNQEIVSYLEAYIERENHLRIWQSNLQDQVIARRNYGYQNFAAKLANMYDVLVLEKLSITDIVKHQKAIIGSQQSTALDRNRTIVAPYELKTILINAFTNRGKQFVEVNASYSTKVCHHCGALEEVHQSSIMHTCTQCHTVWDQDYNACINLLALYNHDNKVGVSYV

SEQ ID NO: 181 - protein, 567 aa, Unknown
  source: /note="Description of Unknown: metagenome sequence"
MNKVSITKVFKYRCFEPVEGLALFDEALDNRHTLWNKLVEIDRDFREKSSQIITPIQSDYQVLDQEIKNLQDSIKAIKRKTRSTAKEETRNIQDTIKELKVKRKEAYQEFKRLKHEAIEREKPLLDCLNNERKEKVKQLRSESGLHGFNFDDVIHNIYDVARIKAMKQGTLLQFKRYSKNGKIAVRPYSSSPLYGSDIHRVNTIFYIESVNQELYNSPIRGVRKKASVTRCHIRVGSADKGKPIFVTLPMVYHRPLPMDGKINAINVKRHYIDHKPIYECLITVTYAIEAPTINPNSCVAVDLGWRMTKDGLRAAYATDTDDKTIECIVTQRQLNEFDTIRGLSSTRQKHFNDCIHVIKAWMANKNLPDWLTDAVAYIDKWKSYKHIFDLYDAFLQHKKSGNQEIVSYLEAYIERENHLRTWQSNLQDQVIARRNYEYQNFAAKLANMYDVLVLEKLSITDIVKHQKAIIGSQQSTALDRNRTIVAPYELKKILINAFTNRGKQFVEVNASYSTKVCHHCGALEEVHQSSIMHTCTQCHTVWDQDYNACINLLALYNHDNKVGVSYV

SEQ ID NO: 182 - protein, 582 aa, Unknown
  source: /note="Description of Unknown: metagenomes unclassified sequences"
MWYAHRYGNVLVEIERARRAAVRLAYGPLATFEHAAKEAGTVVRDAREAIKRARAEHRARVETDAMKLALSSAREAEREAKRALFEARRQLRESGAVDAALADIEARAGELRRGARALSGVHWGTYSLIEAAHDASRKMPLYDGVEPNDPRFARWEHEGQVGIQVHQKGSTGTGMVAEELHAGIGGEWLRVERVHDTRQGRRAGTRARLTMRIGTSDVDGTPIVAAWPMVMHRAVPPGAIVRRATVSLRRRGPREEWSVELTIQVPSTIAPEERQGHVAINVGWRSMGDTIRVASWVGSDGQKGELHLSKRTIEGLRKPEGLRSTRDKNFNDARNALLLALAGLNVPEWYTLRAKALSQWRSPQRLAALATEWKTKRFAGDESAYLALETWRYHDHHLWAWEASQSVGSHRHRREVYRVFGSQLAKRYRTLVLADFDKRVVAIRPAVGDANDKTQNETARSNRQLASTSELEREAANAFTSRGGTAEYLSAVDITHTCADCGALSTFDAAERIHAACSSCGVVFDQDENAARVLCERWRDGEKVGVARVAEPQEKVGSKWQRAKARKEERQAARKAVASAAE

SEQ ID NO: 183 - protein, 634 aa, Unknown
  source: /note="Description of Unknown: plants-endosphere-populus endosphere sequence"
MAFGNKSKPTRKYNYGCRGFLSGPREINPDGTKALRQRFDGHDLAVTQMKLAHQFQNKLVEIERARREAIDPILVRHFPALTTLHNAAQEQQERLQELRDELSQSNSQNRQLMSDPELVEQINAQKRVVSQAWEFYSDQRDAAFADPKVKADLKDNDKSFEQRKADARNAAVEGGLYWATSLQVVGRVKRTGPPPKFKSWRGEEVISVQFQRKPDKTSPKEPVLDSKGNPKIHPRSKKPTFAHVGGSSLRTCDVFTPNTNCWIERTYQPPLTAPHPKYVVIHFRVSSDEKGKPVMASIPAVMSRPLPEDGEVKWVHLSRRKIGTHYRWDVQFDIARDAWTYHPAGQDRAQEGTVAVALGWRLIDGEIRVTEWVGDDGVTGTVRIPKELVEGWSYLDTLQSIRDTLFEAERAELVDWFVNYPNPLPEEWTERAQTLIQWRSADRFMWLIWWWKDHRIPGDEEIFQRMWGRIQLNPTTGRNQYTGGRLQSKHLCDWRAHKRDKIKNWRKDFFRKVAIDLSYQYKDVVIAEIDWNKLAENPEVENGNDIVNKRYRALSSCAQLRDEITRYMNEVTESARNIVTTCCQCGESCDHPKSGRWIRCESCGGEKRDRAVNAATNLLNRALGASGAKVPARV

SEQ ID NO: 184 - protein, 648 aa, Unknown
  source: /note="Description of Unknown: plants-endosphere-populus endosphere sequence"
MVAAKISHLLEFPSMAFGNKSKPTRKYNYGCRGFLSGPREINPDGTKALRQRFDGHDLAVTQMKLAHQFQNKLVEIERARREAIDPILVRHFPALTTLHNAAQEQQERLQELRDELSQSNSQNRQLMSDPELVEQINAQKRVVSQAWEFYSDQRDAAFADPKVKADLKDNDKSFEQRKADARNAAVEGGLYWATSLQVVGRVKRTGPPPKFKSWRGEEVISVQFQRKPDKTSPKEPVLDSKGNPKIHPRSKKPTFAHVGGSSLRTCDVFTPNTNCWIERTYQPPLTAPHPKYVVIHFRVSSDEKGKPVMASIPAVMSRPLPEDGEVKWVHLSRRKIGTHYRWDVQFDIARDAWTYHPAGQDRAQEGTVAVALGWRLIDGEIRVTEWVGDDGVTGTVRIPKELVEGWSYLDTLQSIRDTLFEAERAELVDWFVNYPNPLPEEWTERAQTLIQWRSADRFMWLIWWWKDHRIPGDEEIFQRMWGRIQLNPTTGRNQYTGGRLQSKHLCDWRAHKRDKIKNWRKDFFRKVAIDLSYQYKDVVIAEIDWNKLAENPEVENGNDIVNKRYRALSSCAQLRDEITRYMNEVTESARNIVTTCCQCGESCDHPKSGRWIRCESCGGEKRDRAVNAATNLLNRALGASGAKVPARV

SEQ ID NO: 185 - protein, 488 aa, Unknown
  source: /note="Description of Unknown: plants-endosphere-populus endosphere or plants-rhizosphere-populus rhizosphere sequence"
MIVYKYGALKPKVIGGTFEDLLQYQRHSNAFYNALIEIERWRIAARDIVELAQSAPLSDEQKTEHRLAYNAACRAAGAATPIGWGQKQAVTEMVAAAMKTRRSDEFKARQRASKKGYDFLKRVMTCARPRHRRFDGEGILAATVQGATGLKASAVLTKPGPVQISGDGKHRTVTLRLREGLSLEVPIVYHRPLPERAEKEGVPYDVRVIFARLVIDRIGDRWTYSVHLTIDAAPRVHVAQGGLGRCAVNFGWRRVPGGIRVAYAVDDDGNETSCVFPDALLGRQKHAESLRSLADEIAAAYLGDAARRTKARCSALADPDAIHRELGREWFTMEQAAKRDGTDAEHWARRDRHLYQWERDEYASVLRARREIYRLWARKLAASYDSVIIEAFDMRSVVKRTPSEDDIPAARHYRFLVGPHCLRLEIQSVFGARCEVLKPAKRTLTCHACGALCKWDKARELRHDCESCGAAWDQDANNAKNQLLDAAE

SEQ ID NO: 186 - protein, 604 aa, Unknown
  source: /note="Description of Unknown: plants-peat moss-host associated sequence"
MTTLVYQFHLDPPVSGERAARQQMLAAHRYANDLIAIERGRRDALRAVHDTPAVREAEVLLKAATRSTRKAAVKALWAARREAERIASEVDETLPEVAAAKAALDALPKDAPARVRSVARQTLRAARAEAGDALARIQIFDEALRRGARALTTAHWGTYLSIEASADQARKAPLYADDALTPASPRFRFGARRGYLDESDARSVWWCARSQVGMHVQGRVCRTSGVFAGRDAWVRLEDAEPISHDHNTRRAILALRLDVDTWVRWPIRMHREIPDAARWSWVRVSCRPQQGARGKELWSVEITVDDTAPRPRELAADTLRGAVAVELLWSPLDDGTMRVARWLDSEGKRGEIVLPRELVRGLGEIPSGIRSVRDQLLNDLRPKLTRALRECTETMPTWLREAGATLHLWKSPSRFVDLARRWRASKCDAARAAYELLDAWELRDTHLDDYENGTRARSLRRRREVYRVLAARWAQSYATVLVPDRDLSREARWGEESERRFLASPQELRDCLRKAFGDGAVDVPWRGPHGVVDDGDEDADVPEWLEKAIEQWRDEEKSGSARKGGKEKKNGEVAMSAWARRQAAARDRDLGKETARKAANNDAE

SEQ ID NO: 187 - protein, 683 aa, Unknown
  source: /note="Description of Unknown: plants-peat moss-host associated sequence"
MKIVYRYGLRAPIGHTPTNPTSKEVCKCPVCEQLFLAHSYANTLTEIERGRRAAVRALHAQVGDTGALELAVTEANQACEKAASNIKRLRAQAFSVLAQRGHTEGAAKRGTRVTPPEMARELADARKRKQEATTRLVEHRRKIREDPAMIVGEHEITERAKELQRSARKYAGVYWGTYLLVERAHGASIASLPLYDGAGPNDPRFDRYRGEGSLAVQIQQQTGDPAFTVEQLSGSDSRVQIQKEAGRLHTRLKRDEEGRVVREGPLVEMRRGNCIVARPQAVRETYSMVGDTMLRLRIGSENRAPVWAEWPLKLSKPLPKGAIVSWVTVTKRMTGPREEWSVQFTLDTVDEVVQRDVDEEDARVVAVNFGWRLMGEELRVAYWRSETGRNGDLRLPASMLAIRAEAEEVQSRRDKEFDETRARLCKWLASTEVPTWLRDATKALAQWRSQARLVHLAKGWRVQRFAGDQEAFETLEAWRYHEHHLWQWESSVRATAVRSRDDLYKRWAKILADNFDVLVIAGDFDVRKVAERPEVDEEIQGPAAAATSRQFAAPGRLREILCHAFTKAGSKIAKERGADITRTCQVCGLVEEFDAARSVIRATPCSGCNATWDQDDNACIELLARYDRTCEKSKNTSSDDGARAEPKNETKKAAGSHWDRARQKKVEKLKKVEAARQALENTG

SEQ ID NO: 188 - protein, 698 aa, Unknown
  source: /note="Description of Unknown: plants-rhizoplane-corn rhizosphere sequence"
MEPVKKSNARKTSTSETKVYSYGAFLPKESEQIKLINDQLYFAHKYRNKLVEIERKRRNRFRNLRKLMSPELRQLENDLLLTEEKIIELRKSFGGRAENSLDPKFPKKNRQLTPQAVEIKDLKLKKKDLSAKIKSIHTQLNLDYFKEADSKFSLLKKERLEQKAKELNKDSLGPNDVNRHNVVNNLYKEMIDGGNRFWAIKAKISKSAEASNKRARSNCKCSSGTYVSIEEAAKQSFSNSKFEPKFKSFDGSGKIGMQLTQNKGLSIKDALSGSSPVLKIDLHPEVYLRQNKKKNKVLATARIKLFGTEKTGKFVDIPFIMHRQMPEDATIKWVFLVVSKIGYRSIYNIQFTIESNSFTQPSAIRPDDVAINLGWKVNDQTDDITVATSFDGKNYNELILPSKMRANIVYKETLISHADKHFDSVKKDVSKWLKNSNLDECITKYFTNLPQWRSHKKLLFVSKELAKVFLPDNTWYDLWKKWKTHCKENKPWKNCSDKDDLFTTLDNTIQWCKDNSIDDPNVQMAFYLKTWAEKEIHLINWARGIESKLRKHRKEIYRCFAKKLSSTYGKVIVENWDKSKTAETPDVENDNRTKQEENANAVRQFVGVSVLTDALKQKFGKDFCEENAKNISKEHFKCGGELINQKELSDVHCKKCNKSVNVNYNAAAHLFDRHGERSGAVKLPGTARKTRKSPELLA

SEQ ID NO: 189 - protein, 637 aa, Unknown
  source: /note="Description of Unknown: plants-rhizoplane-miscanthus rhizosphere sequence"
MRIYAYGARPPVENAELVFEQLRLAHAYQCALVAIERRRRVVVDRLYQSACPAEWNAYEAATARVQEIIPRMRMTRTRPGDMLPPDMEMQVEEREIVKQIKADLAAAREAEQVARQAWYAAKKMATPRLRARLRMCDRGAYARAKRAYNLASAVGLAWGTRLKIAESVERAGKAAAKHGTLPHFPRFDGGGTIAVQIQGGLDAEAVFGGVDTRFRLNVVDAATWNALQGKSATQSVKKSGRVVDLPQPIEGSRRSTLRRGPIARLRIGSEGRQPIWAAWPVTLRRGLPLKALIKWVQIHARKIGSRTEWQLLVTVDDAKPAVHAEGPILAVNLGWRNLEDGGLRVGYAVGSDGREEEVRVPPRYTSGVAHVDSIRSIRDKLFEAVKEFLSDWSDESPRPPDWLVDATRHIDQWRSPARLVTLLREWERKRFVGDRKTWERLSAWKTKNAHLRFWECDERRKLLRMRLDFYRCLAARWASQYARVVVTDMDLRDFAKLPEPEEAADTEGQTQRRSRVLAAPSELRGAIKNACSTRGTGYEEKKAAWKTQTCNACGVVFAFAAKQDLLHICECGARWDQDANHCRNLLASGPVLHGAMGSLAPTGKQMESTDRPAVDGRWKKRRSRTTVEALKKTAKSA

SEQ ID NO: 190 - protein, 693 aa, Unknown
  source: /note="Description of Unknown: plants-rhizoplane-switchgrass rhizosphere sequence"
MPRARKEKSPTKIYTYGLLPPEHGGEDLMRMLRAGHNYRNALLEVERDRLAETEDFWAKRGRYTELVARVRELEAVRFPRKDDPRRQAHYDLIDDLREKVREKREATIQGSLPAEEGRRRLRSRELKAEAKKRGETLTKEQMTRLLDREPGCVSVRRKAQLDYEAQSRARGVEPSPKGMVAHLRALGLNTITQEIDDRATQKAKKAREHFKVYYGTYLLIEAQVERALEKTQFPRFKRWTGEGRVGAPVDTNFGLSVDSIHDCQFDSKHGWEENRGNTVLQIDPVGVSCAKGFHTRARVCVDSRGRSGSKRLSVWVDFRINYHRELPRGAKICGAWINIYTLGTRVKYELQLQVQDDSFQVQPRHGTGVAAINLGYRSSGRVAYVLSEDGKGRELLVSPRIEASIGRADTSRSDRENSANRMCDMLLGWSSELGFPEAFLVGDGESKIDTWSGSVTRRSRSLSTRISALKDAREESLSNKLRGILGTWAKLRQDKQTRPSDEATYAAFVEWFHQDKIYQNNEAFTRSGARNYRDQVVRDWAHELCDRYEMLLVDGTDYAKLKMRPKDKSVMPIENQTEIAHRRDNFAPGNLRSIIEEVARARGVTVDRHDPSGLTQRHHACGWDEPWDAMPRIEHKCAGCGETFDQDANFCVGLFERFRGILPPAPARSPRTSRKNRSSSGSERAGGGQEAAE

SEQ ID NO: 191 - protein, 586 aa, Unknown
  source: /note="Description of Unknown: plants-rhizoplane-switchgrass rhizosphere sequence"
MNRVYEYGLLDPVVNAQIVEDQLRAAHRYRNLLVEIERERRTRVREILSSHADAAPLAEDVARLTVELEQAQAKIKQVRAVSRRRSETTDDRMAVRDVTTRLKAAREQLKIVKAAVAQDPSCQEALAQAEQRCHDRRIEERARCGVFWGTYLLIEEDVDRARKGKMDPKFVRFTGEGRVSVQLQGGLEWGGIAEDTRIQIRDAPDPRQGRRAGTRKWLRLRVGSTGRDPIWAEWPLILHRPLPEGAVIKRATVTRWRRDCRRWEWRLQLILDVSRCVGTKPRGTEGACALNLGWAKTERGLRVGFVVGSDGERTEIVLPGSILDRLDKANAIRAQRDQNLDVMKPLLAAWIAAHPLPEVLHAKIEHLHAWRSADRFFGLARLWRQHRFDGDTEGYELLESWRYRDEHLQRYEAGMRRGALGHRREVYRLVGAALSRRYRMLIVDDTDLRTFQRSPAPESDRVEFDAVKRSQHVAAPSDLRMQLANAFGEDGVAELSAVDVTRRCHACLTLNDWDRASSGREHACVGCQQVWDQDVNACLNLLREWRTVAPGWEAARVAKASNRQASRAERLQQARRKKKPAEAIAG

SEQ ID NO: 192 - protein, 626 aa, Unknown
  source: /note="Description of Unknown: plants-rhizosphere-miscanthus rhizosphere sequence"
MPVIVYEYGLSPPKVNAALVEEQFRLAHKYRNMLTEIELERRTKIRAIMASHPDMVPFETELAEVQAEIEKLRGEINAIRMAARKRASTPEQSRRIKTLAARARELRTEIKERRKRVAAELAPDLKAIQDAAVQRRKDERAKSGVYWGTYLLQEAAADQARDQPMPPKFTRWNGDGRVSVQIQQGLAKEGLWGESRQVQIATRIDSLVYDHEVTRRGDRRRLYRTTLRMRVGSTDRQPVWAEWGIAMHRPIPDGAVIKVVTVSRRRCNSTQWWWRVQFTLDTTDCKPRQRPEYGVVACNLGFSQTDSGAIRAGYLVGDDGFEQEILVAKSDLYRGRDLTPEQKQKAMTYVRDCLAESSEIRGARDKSLAEFKTRFLEWYQIAKATTFGEDAIPEWFRDRMEHFHMWRSPARVREMMLHWASNRWAELDDPESRWPDSRGFEMMSTWVDEDTKAEVKESSLRNKALGDRREAYRIVAATLAKRYKTLLIDDTNLKHLQDGPEPEDAEGDIPAVKYQQRLAAGSELRQVLINAFGGTNVVKMKPSNMTVTCSGCGARDVSWDRADGFRKHRCSACREIWDQDANFCRNLLKEYARGEAPEAKVAKPSRSQRFHESRKKKAAADQQEQG

SEQ ID NO: 193 - protein, 617 aa, Unknown
  source: /note="Description of Unknown: plants-rhizosphere-populus rhizosphere sequence"
MATIVYRYGVRTRTETGRYDLPAEVWQQIHLSHRLRNALVEVEHRHDEAMRDLWSAHPQVAEVEQRLAAAEQMVAELIDQARLEHSQDRTTATRRGTATNLREARRAVRDARAARRAAIGEAYPVVKPGIEAVRAARKAAIKDLYREYCQDGDLYWATYNAVVADHRIAVQAVERKRRQGQAAQLRYQRWDGTGTISVQLQRQAGQPARSPELLASGDGQWRNVLQVRPWMPPEQFDGLTRGERKRHGRGEAVWSVGGGRTVTLPIQVHRMMPADADVCEAQLVVTRTGAHWSAALCVTVRLPDPDPVEGRSPLALHCGWRHRPDGSVRVGTWASPEPLVPPANLADVLAAHDSGRWGEIVIPASWLELAGRPAALRSRRDLALEPVQRKLAEWLDQNPQPDGDDGRPGLTGGDVRRWRSANRFAALAIRWRDTPPPGEGAAEMTAVLEAWRRQDKHLWEWEAHSRARLRGRRDDAWRKVGAWLAEQAGVLVVDDVDLAALRQRGDVADDDPVLPGTAAGQARARAALAAPGRLRQCATGAADRRGVAVRTVESGYLTRTCPHCGERGDAHPRYAQSAVVTCPSCGRSYDQDRSAATLMLDRERSGDGPGKGERSQQ

SEQ ID NO: 194 - protein, 646 aa, Unknown
  source: /note="Description of Unknown: plants-rhizosphere-populus rhizosphere sequence"
MKRRTSPLPTRIWSYGCLRPTTNTDAFFDQLRKAHVYYNTLIEIERDRRAEYRKDRAKLCPDIEKFEAEFLELDKAVDLFRATMKAEKKKKDDTGELKRLKDARKAIGEKLKALRLEMKNSPELKKLQEKEKEVVSGKVRAARKSSGVYWGTYLLIEKAVETARRSKMDPRFAKWRGTGRIGIQLHHVKWSDIVDGKSQMFQVDPLPETQWDTRKGRRHAYTKARVRVGTEKSATTGKQVPVFVEVPLYLHRRPPADAKLTWAWIFVTRKGPTLRYQLQLSVESNLFSAGLPEQPKKSVCAVDVCWRKMDHGLRLGLAVDHHGNQFEMVLPKAVPELIEMGDNMKSAADRIFNGTKDFVSKWIKENGLPGAIEPARVSQWLSHRKLRGLTRQWLAETIGFERARELWRAWCFERVGSRKNPLTVPKKDLFAPAEEAFAWAEKHGLTKPFEQMAFYLELWSRKDRHLEQWAADQFYRATMIRRDAFRNWSRFLVNNYETILLEDMTHTTFAKDSVVEAEKSFDVLHRQRNEAAPGLFMQTLRSAVGAHVVPMDPADTTNDCAHCRHRNDWSQTERSKNVVLTCAGCGKMFDQDANAARTMLIRYFEGDTGSGGSKDKPKPASPPPSKPPPRALTKRRKPGAEPRASV

SEQ ID NO: 195 - protein, 710 aa, Unknown
  source: /note="Description of Unknown: plants-rhizosphere-populus rhizosphere sequence"
MTEKPPTKIYTYGLLQPTKNGHEFSKMCRAAHDYYNALLEIERTRQREEDDFWAKRGGYVDLLDEFRQLEAMRPRRDDPKREEIFARRKELRKKLWELRDVTVDRSLPIEDANRRNRHRELKKAAKAEGRNITDAEISASLDKDPSCVSPRRRAQLEYTEEAKARGVNVSGRGLNQYLRDRGLLKVTQPIDDRAAEDQKRARDHFELYYGTYLLVEPAAEQAIERSEMFPAFKPWRGEVGRVGAPVNTNTGISVEAIHNCFNEDPKTGERTFSDGGNTVLQIIPIRKEVRESRRVRVKGAPSAHQQGMKFLNQTVMRICVRSEGRVGAQRIPVWVEFPMQYHRDLPPNAKVTAAWVIASQLGTRTVYKLQLQVQDEAFRNPVKPCGRSTMAVNLGYRSTGRVAYALTQDGRYEVMDVKDRVGKCIDEADELRSLRDRDANRMRNDLFEWRDVEAYPQSFLEGDGEKFVPHWSGDEKRRRSVKVRSMKTRIDGLVHARDDSLPTRLRAIYETWERMREQGLLRSVDDRIFKVFREWYIEDKRSQDKEAHQRLNAHGTRELDIYAWAHRLCDEASLILVEDTNYATMKLKSNRRPKEELPVEISVSIARRRDMYAPGRMRKILEQVAVKRGVKIVRLSSVGLTQRHHKCGFDEPWDAMRSIQHKCEGCGVTFDQDRNFCEGLFERYRGTLPAAPARKAGKGKKSRDLPAEAE

SEQ ID NO: 196 - protein, 713 aa, Unknown
  source: /note="Description of Unknown: plants-rhizosphere-populus rhizosphere sequence"
MRSMTEKPPTKIYTYGLLQPTKNGHEFSKMCRAAHDYYNALLEIERTRQREEDDFWAKRGGYVDLLDEFRQLEAMRPRRDDPKREEIFARRKELRKKLWELRDVTVDRSLPIEDANRRNRHRELKKAAKAEGRNITDAEISASLDKDPSCVSPRRRAQLEYTEEAKARGVNVSGRGLNQYLRDRGLLKVTQPIDDRAAEDQKRARDHFELYYGTYLLVEPAAEQAIERSEMFPAFKPWRGEVGRVGAPVNTNTGISVEAIHNCFNEDPKTGERTFSDGGNTVLQIIPIRKEVRESRRVRVKGAPSAHQQGMKFLNQTVMRICVRSEGRVGAQRIPVWVEFPMQYHRDLPPNAKVTAAWVIASQLGTRTVYKLQLQVQDEAFRNPVKPCGRSTMAVNLGYRSTGRVAYALTQDGRYEVMDVKDRVGKCIDEADELRSLRDRDANRMRNDLFEWRDVEAYPQSFLEGDGEKFVPHWSGDEKRRRSVKVRSMKTRIDGLVHARDDSLPTRLRAIYETWERMREQGLLRSVDDRIFKVFREWYIEDKRSQDKEAHQRLNAHGTRELDIYAWAHRLCDEASLILVEDTNYATMKLKSNRRPKEELPVEISVSIARRRDMYAPGRMRKILEQVAVKRGVKIVRLSSVGLTQRHHKCGFDEPWDAMRSIQHKCEGCGVTFDQDRNFCEGLFERYRGTLPAAPARKAGKGKKSRDLPAEAE

SEQ ID NO: 197 - protein, 558 aa, Unknown
  source: /note="Description of Unknown: plants-rhizosphere-populus rhizosphere sequence"
MQRQKDDSITSRVYVYGCVPERVAPVHNEDRALEQMRLGQRLWNVLVAIDRARVARYRRIMADEAQERIDALRDQAAALRDEIKTRRKQARKRSVDIGDLAERLAAVKSELSALIEEQKRTSTERHDARRAELTAMQERTNHRIKRARQAAASLGLFWGTYNDIVQRSDAGRKHGGELHFRGFRGEGTLTAQIMGGAIVTRCVEGAHTFFQVDPPQPGRKWRYARMRIGSEERGGVKLAPVWLEIPIVYHRDLPPAGMIKSVSMTRRMLAGKPRWQLNVTLNLPAPKPTTRTAAVAIDIGWRLLPEGVRVAYWMDDAGQHGQVLIPSRDISQFERVRSLRSNCDLSRDEILPGLAEWFGGLELPAEWAQRVAYLSQWRSSDRLAGLYDWWRDHRLPGDAETFEAYTTWRKQYLHLAHWWRNLQDQMTLRVREQYRVFAAQLAGRYGVVYIEDFDLSSVARKPKTEGDGEKSASSTYRQMVSPSMFRGALLNALQREGATVTELPAEYTTRICSTCGYGREWDQAESVMHRCGGCGEMFDQDENAAKNLLRLVAQGVAG

SEQ ID NO: 198 - protein, 597 aa, Unknown
  source: /note="Description of Unknown: plants-rhizosphere-switchgrass rhizosphere sequence"
MTTLAFKYGLGDPLDWDTDIADQLYLQNKLWNRLVEIERDARTRYRAVVGEDDAIAPLVRDIEAAKAQKEALLTERKGLRAKARKRVPTPEIDARIAECATVVRELAQRIKTERVAAKERLAPHVRAIEEWRFGAVKEARNASGLWWGNYNAVCASYDTARSRAMKDGAELQFHRFTGEGRLTCQIQGGTTPEQIVDGKCSLVRVDPLSAGAHSHPSRGERRRLQRTKIAVTAYMKDGERRLLTLPMQMHRPLPDGAIVKQVVVTRRKIGTRYRWHAVFTCSVPDAQPVQHASTSACGVNFGFRQVLGGLRVATVSTSPSKTPDYLVLPEEWLRAMDRCEALQSARDEHLLPMHAAARELTRGEDAPESLRDKLDRIARAPKIGSALLASLVLAWRDTHADWQSDKLVGFEAWRRNDKRAAEEQANLRDKLHASRTERYRLWARELVRDHALVGCGKIELRKLAELEKQDGTENDLHARARSNRQRVSLYSLQLELARAAQLAGARVVMADGPLTSTCHACGATTLIKPDIMQVCDHCSAVWDQDHNAALNALSYAQQSPPPRERSGDAQDTDQENQVFGEPAEEKKDSARNVRLAA

SEQ ID NO: 199 - protein, 635 aa, Unknown
  source: /note="Description of Unknown: soil metagenome sequence"
MHSRVYLYGLLPPTPACAPLVEQQMGRAHRYRNVLVEIERERRAKVREVMAAHPDMAPLEEQVNALVAERETALQALPRKAARNDPARANVRAMATRIRDLRGQIKAARKAVLADAEVARQLAEADEFSRERVRRARATCNVYWGTYLLQEADADRARMERMPPKFHRWTGEGRVSVQLQGGLEQDKMWGGDTRMQIDPVAPEAHDPLSPRGVRRRAHRTVLRLRVGSDAQRGPIWAEWPMLMHRPLPKGAIIKVATVSRRYRNCTTWDWQVLLTVSIPDESARPAPAAGVVALNLGFCERPDGSLRAGYLVGDDGWTQEIVVPASTSELLGKCDSIRSFRDKNLDAMRPLLSAWRQDQNLAFERVCRDVIAACETTPPELDGAFYRLAMYIVNGGHSLPSWLHERIQSVHAWRSHDRFRKLALTWRDRRFPGDHAAYELLEVWRYRDQHLEHYESGMRRRTLLRRREGYRIIAAAAAARYRTLLVDDTDLRHFQRKPDPEDGATVPEQIGLATMRVNQRLTACSGLREALASAFGSRVVKMSSQNVSRRCHACGDINLAMSSAREQTCTGCAATWDVDQNACLNLLGEHRRDDPDRETARVAKLANAKPSRGKRLSAARASNGATVLAREASGN

SEQ ID NO: 200 - protein, 628 aa, Unknown
  source: /note="Description of Unknown: soil metagenome sequence"
MKRRTSTAPVRIYAYGCRLPTQGGELVEQQLLFRHRYYNKLIEIELDCREKMRAARSASSEDVAHAESAFAIYETEIVGVLDAIKAKKGAARAAKVDAAEERAVLAVLRDMKRKTIDDLHAAKLAARTPELLAEFTAIQEAANAEVRDARSKCGVYWGTYLLVEQEVEQAVKAARKNHEDPGFRRFMSVPNRQGQATIARGRVGVELIHGVPVATIMAGTDTRLQIHMEKSDSKRGQTMARAKIRVGTAENGRSPIFAEFPFRMHRPLPADGVVKWAWISKSTKGRWVDWSLQIVVEAASLHRPVRQPSDGGVVAFDIGWRVRLHEVVNELRVAYWHDDQGNHGELVLPSDDRVRVDSRGRKHRPEGVRGRFDHVDSLRSIEDKNFDAIRSELVAWKTGRDLPEWFVSALEWLHAWKSHRKLGAVFDQWRSNRFSGDDGMFAKVETWWKQHRHLYDWESCERDRALNARKNTFRQWAPQFTRKYAVVVLEEKFLAEVAKLQAPDSTKANMPRPTRRNRTVAACGEFVLALKNAAPGNGCTVDAEPCEDTTATCARCGYVERFDHRPLAHACARCGDVSGPVDQDRTAAENLLAAYAGKMSRSQSASEGGNIVGDPDGSLVIPAQEGVS

SEQ ID NO: 201 - protein, 617 aa, Unknown
  source: /note="Description of Unknown: soil metagenome sequence"
MIRVYRYGVASPHDGADLVYAQMRGAHAYRNTLIEIERGRRGALRDLESAEVRGLTAEVAAADEACQAIGSTIKVARAESRKRSERKVDLERLAEARSVKRAITGRLYEARRNHMLATRSAVDIVNELAKCLLKSAREHCGVYWGTYLLAEEAMGASSSAPLFGKDGITQNDPKFIRWTGDGAVRVQIQKGASVAAVRADAEHSQLQIREPTGAWSHPTRSERRRLAKRGEVRIRVGSEPNGKPVWAAWRLDMHRPLPEEARIKEATIHVRQRGAHSEWSLLVTVDVPPAAVVPSESRGEAVGVDVGWRLIDGCIRVAVCMGAGGAVTELRLDAPTIRLLRSSEALRSKRDERFNAAKARIRKAAAEPVAPEWLRESGKTMHAWRSPQRLAQLHARWAEERFSGDDMVFGRLEAWWWTDRHLWSTEAQASLQGHRRRKDIYRVFAAKLAARYDVIVLEKFDLRKVARTEETGEETPAGDNDTSRSNRQLASVSEFRACLLDAARSRGRSVVMVDASETTRTCHVCGLVEAFDAAAHLRRTCACGSEWDQDENAAEVILARWRERPGDAKILVPARSTEIYCETMELLETRWQRVARLRKEKLARMDTARKSASNAAE

SEQ ID NO: 202 - protein, 595 aa, Unknown
  source: /note="Description of Unknown: soil metagenome sequence"
MMVFKYGTVPARIAPVIGAEQAAIQLRLANRLWNLLVAIERARVARYRKVMFDAAQGRIELLKAKLSALRGKIQVRRQAGRRRVDVSDLTAESQEIRAAIKAEIKAHKATSAERHDARRAELDALSETSKSRIKRARQAAASMGLFWGTYNDIVQRADVGRRAGELHFRRDTGDGTLTAQIMGGADPEECMTAHSFFQIASKCPLSGLVAGDVAETDAQPVKWQYARMRIGSTGERQPIWLAIPIVLHRPLPDGARIKSVSMTKRKTTWSLNVTVAEPAPTPKLIGPRVAIDLGWRVVPSGVRVAYWADTLGGEGQVVVSDEDIGQFGRVRSLRSRCDTMRDEYLPVLAAWTSGRELPAEWQAETIALVQWRSPDRLARLIRWWARLPGDAEMFSRASAWRKQYLHLANWWRNLEDQMRGRLREQYRIFAAGVAKKYSTVYLEVFHLPDVIETPAAESEEVRTAESRYRQMVSLSVLRAAVRNACTREGCTVVDVAPEYTTLGCHLCGTITEWDTAASLMHQCKGCGAVWDQDQNAAINLLARGASGGAPPTANQPDRPRKWDRVRDRSRKSAQAAESAILAAAAVEMPAQRLSC

SEQ ID NO: 203 - protein, 638 aa, Unknown
  source: /note="Description of Unknown: soil metagenome sequence"
MTKPLSGLVAETGLLFRAFRAARPSSKCLLSGLVVETECDNVVMMVFKYGTVPARIAPVIGAEQAAIQLRLANRLWNLLVAIERARVARYRKVMFDAAQGRIELLKAKLSALRGKIQVRRQAGRRRVDVSDLTAESQEIRAAIKAEIKAHKATSAERHDARRAELDALSETSKSRIKRARQAAASMGLFWGTYNDIVQRADVGRRAGELHFRRDTGDGTLTAQIMGGADPEECMTAHSFFQIASKCPLSGLVAGDVAETDAQPVKWQYARMRIGSTGERQPIWLAIPIVLHRPLPDGARIKSVSMTKRKTTWSLNVTVAEPAPTPKLIGPRVAIDLGWRVVPSGVRVAYWADTLGGEGQVVVSDEDIGQFGRVRSLRSRCDTMRDEYLPVLAAWTSGRELPAEWQAETIALVQWRSPDRLARLIRWWARLPGDAEMFSRASAWRKQYLHLANWWRNLEDQMRGRLREQYRIFAAGVAKKYSTVYLEVFHLPDVIETPAAESEEVRTAESRYRQMVSLSVLRAAVRNACTREGCTVVDVAPEYTTLGCHLCGTITEWDTAASLMHQCKGCGAVWDQDQNAAINLLARGASGGAPPTANQPDRPRKWDRVRDRSRKSAQAAESAILAAAAVEMPAQRLSC

SEQ ID NO: 204 - protein, 628 aa, Unknown
  source: /note="Description of Unknown: terrestrial-soil sequence"
MKLVYKYALASPHENFDLIDLQMRAAHRYRNTLVEIERGRRAAVRLVEAEAGDMPAAQRALTMAIGARELADGAIKRHRARSRKRDEPQEMRDTLRAARVAERDAAKAFRELRLKIKDSPAMIAARDAIGERAKELQRSARANCGVYWGSYLLVEGAVSDSFSDTSLYNKDGHANDPAWARWTGEGSVGVQIQTATADKATKSLTVERAASGNDSRLRIVLPDERAWDRSGRTHRECENMARQAQLSIRIGSNGRDPVWGSWRMDMHRPLPVGSTIQLATVHRKRVGPYDRWHVTFTLDVPASTRASTAGTGTIAVDVGWRVMGDELRVAGWQDDTGDRGELRLSAKDLAVLRAPEAMRSARDLRFDAARLALSVWLRDHREILPDWLRVISANVHAWKAEARMVALRNRWMDARFADDEAAYDALTNWAFRARHDWAVESCARGQALRRRREKYRVWAAQLATKYDTIVIENFDKRRVAATSRDATTENETARANRVLASTSELVSCMETAARSRRAALFAVPCADTTRTCPTCGLVESRDAAAAVRLECECGARWDQDVDGAPLVLLARWRERPGDAKIVVSAREQEKTNENGEKKEGRWAKVARLRAEKVARMATAREADADGAE

SEQ ID NO: 205 - protein, 660 aa, Unknown
  source: /note="Description of Unknown: terrestrial-soil sequence"
MWSIGASVATRCCRRRPSDRYGSDKRNKEIVTMKLVYKYALASPHENFDLIDLQMRAAHRYRNTLVEIERGRRAAVRLVEAEAGDMPAAQRALTMAIGARELADGAIKRHRARSRKRDEPQEMRDTLRAARVAERDAAKAFRELRLKIKDSPAMIAARDAIGERAKELQRSARANCGVYWGSYLLVEGAVSDSFSDTSLYNKDGHANDPAWARWTGEGSVGVQIQTATADKATKSLTVERAASGNDSRLRIVLPDERAWDRSGRTHRECENMARQAQLSIRIGSNGRDPVWGSWRMDMHRPLPVGSTIQLATVHRKRVGPYDRWHVTFTLDVPASTRASTAGTGTIAVDVGWRVMGDELRVAGWQDDTGDRGELRLSAKDLAVLRAPEAMRSARDLRFDAARLALSVWLRDHREILPDWLRVISANVHAWKAEARMVALRNRWMDARFADDEAAYDALTNWAFRARHDWAVESCARGQALRRRREKYRVWAAQLATKYDTIVIENFDKRRVAATSRDATTENETARANRVLASTSELVSCMETAARSRRAALFAVPCADTTRTCPTCGLVESRDAAAAVRLECECGARWDQDVDGAPLVLLARWRERPGDAKIVVSAREQEKTNENGEKKEGRWAKVARLRAEKVARMATAREADADGAE

SEQ ID NO: 206 - protein, 628 aa, Unknown
  source: /note="Description of Unknown: terrestrial-soil sequence"
MSEQLDDTPEQPNEVEETKKRKQRNKGKHPARIWSVFSRYLVSGREHFDKQVLLAHRFRNKLVELELQRRAAANVVIAQASSELQPLIDALAAAEQVLEVSLQELKAVRAKHRRRAESAAQRDAVTNARTARNQASKALSKARKDAFASEAAQVGLWLAEEHHFQAVLAARHAFINDGLYWPTATDVQDRARAMRKGAPPVFRRFGGAEQAGRIAVQIQQRTDKSQSEGGITFEEAFSCSHGFFRLEKKPGRDPLPEIADQPDYKSKRQQLLTYARAWLRVGSEGKGARAKPCWVVADVLLTRQAPKTARIVQVYLDHSVIGDRERWRLSLVLTNQEGWPKPNRASGCMVGIDLGWRLLDTGELRVAYACGADGQHHELRLPASLVKVWRRPDRIQQERDNLFNDVKARLLEWLKGREDLPDWLKEQAEHLHLWKSSTRLSRLVDHWAGRDINWSSQRRIAGDEEILASLRGWVKRNLHLRDYQYHEREQLAAHRLDVYRKWADGLARLYQTAVLEDADWRDLARLPSPEDDAVNETARYNQRMASPGLLASVITNMFAITSRVECANTTRECWRCGHTEAFDAEAQLIRVCPGCGDACDQDESAARVLLARGQALNQSQVAEAAPSS

SEQ ID NO: 207 - protein, 622 aa, Unknown
  source: /note="Description of Unknown: terrestrial-soil sequence"
MAVVVHVYGVPPVLHGERVRLPAEVDEQLSLAHCLREDLVTLEHQRQDAVTAVWSSYPQIAAIETQLTAAETELTDRSAAAAAERSAARKKGPTESSEAVRQLKARIKDLRSQRRTAIADAHPTATPRLTAIADAHRAAIKALYADYSQGRGLYWATYNDVVAHHQVATKRVAAERKAGRPANIRHHRYDGSGSITVQLQRQTGAPPRLPATIADEQNGPWRNVLYLTPWVDPDTWATLARAEQRRRRLGVVRLDLGNKRHLSIPVLVHRMLPADADITSARLVVRRVAGHRKIELHVTARIKDPVTRSGGPAVALHLGWRREDGGAVRVATWRSTAPVHVPDDLNDLVHADTDHTGTISLPARWWHRVSTQPEMAARRATSLNDIRDQLVAALTDNPLTITADDEDAQPVPTAAAVATWRSPARFAHLARTWATDCPAGHQATAAALENWRRSDRRLWEQQAHGTANTLAARADAYRRTMSWLLTGASRLVLDNTAIADLARRADPATEPTLPTAVTDRVAHQRIGASPGQLRSIATTTANSYGVAVAVMPHTGITRTHYRCGHLNPADDRYSAARIVTCDGCGQHYDQESSATLMLLAASGDVAAPGSATARNPDTSAHA

SEQ ID NO: 208 - protein, 605 aa, Unknown
  source: /note="Description of Unknown: terrestrial-soil sequence"
MTTLEARVAQYGCLAPIENADVVRQQMRLGARYYNELIALERCRRAVYRDLRRKYVDLESVEARVEELAAELMSLREAIKGVRKEARRRVDTADLDQRAKDVQSALRVARVALKDARQAARDNAELRAAVEQLDERAKIWSKALRAMRAPWWGTYLLEEASAEQARKATIDPSFRRARGRERISAAGEGSAEGRIGVQVQGGMTVAELYGCEDTRLRIEPVSPDAWHASSRGVRRRCSRTRLWMRVESAGRSPVWAVFPLILHRPIPDDARIKGAVVRLRVLGFREQWTVSVTYAREPAVMPERPGIVALDLGWRQRPDGSLRVAYCADDQGNHREVVMPESVRMRLRKARDLREIQDLHFNRAVRWLARWLDAGKAPEWLARERPHLGQWRSHGRLRRLVLDWRRTRFVGDERIFAAMERWLHRSRHLYQWEVDAQRKALLARRELYRCTAAQIARAYGRVVIEQFDLATAKRLKAPEQGEDAPLAQRAQLHASAPGEFRQCLTQAVQREGGLVISVDASGTTSHCHACGGVCSWEQGEELWHRCEYCGELWDQDHNAAINLLRRFTRDHSGDATNPAPARKPSKRAERFRKRHAQPAATDVAE

SEQ ID NO: 209 - protein, 596 aa, Unknown
  source: /note="Description of Unknown: terrestrial-soil sequence"
MELNAKPDDLELDDDIPAGEEEEEKPDLDARVAQYGCLWPIQGEDLIRQQMRAGHQYMNNLIFIERCRRTCYRDLRREHANITEIEDLCQTLAHELDELRDQIKGARKAARSRVETKELNAKAAEVLKRLQPARKELKAARTAAAQNEVLKAAVKELDARVLLCQKFLRKQTDCFWGSYILVEASMKQVKKSKIDPYFRRWKGEGRIGVQIQHGMTVQRALDGVDRRLRIMPAPTSFLGENKSASHARHKARHLLYIRVDSEGRYPVWAVFPMIMHRDMPPDALIKGVTVHCRKRGLRDKWSCDITFTKPAVKPAKKPGVVAIDLGWRKRPDASLRVAYWVGSDGQDGEIRMPERVSRRLRHSDGLREVQDLSFNRMKSRLKLWLNAVDARDETLDKPMVPDFLTAIQPHMDKLRSHERIRKLVKQWEHERFEGDEHIFWAVKQWFRSSIHLYPWEVSQRKSTLRYRREMYRLAALELSKRYGTLVLENFDLSKAKRKNAPEQGPDAPKAQRTQLHASAPGEFRQALVQVFLREGGEVFRVDAMGTTSSCHACGATCKWDQAEEISHRCEHCGTLWDQDYNAAKNLLLRYALPQAS

SEQ ID NO: 210 - protein, 488 aa, Unknown
  source: /note="Description of Unknown: terrestrial-soil sequence"
MIVYKYGALKPKVIGGSFDDLLAYQRDSNVFYNALIEVERWRIAARDIVEMDQAGPLSDEQKTEQRLAYNAACRAAGQASTIGWGQKQAVTEMVAAAMKTRRADEFKARQRATKKGYDFVKRVMTCARPRHRRFDGEGLLAATVQGCSGLKSSAVLSKSGPVQISGSGKHRTVTLRLREGLSLEIPIAYHRPLPERAEKEGVPYDVRVIFARLMIDRIGDRWIYSVHLTIDAAPRAHAAQGGLGRCAVNFGWRRVEGGIRVAYAVDDEGNETSCVIPDSLIGRQKHAESLRSLADEIADAYLGAAARRTKSRRQALASPDATHPGLGKIRFTLGQAANHAPEDAEHWARRDRHLYQWERDEYASVLRSRREIYRLWARKLAASYDSVIIEAFDMRSVVTRAPNKDNIPAARHYRFLVGPHYLRAEVQSVFGKRCEISKPAKRTLTCHACGALCKWDKARELRHDCESCGAAWDQDANNAKNQLLDAAE

SEQ ID NO: 211 - protein, 711 aa, Unknown
  source: /note="Description of Unknown: terrestrial-soil sequence"
MIKNYEYGLLDPTANAQLVDDQMRAAHRYYNQLVEIERERRAEIAAILVGHPDTEALAARVADLARQREEARLAIKATRQATRDRSETSQMRDRVKDLATELRAARATLKTARDVIKTDAVIVAAISACDDRATTRVKARRAACEAYWGSYKLSEEAVDAAKKAKAPPHFKRWTGDGRVSVQLQGGISDGELFGTDTQVQVAPVSPDAHDLRKPRGVRRLASRTILRLRVQSTEKGRPIWAEWPMILHRPIPEGARVKIATVSRRRRDCRRWDWRVLLTLEIPDGASEHRRLIPASGAIALNLGWCKRPEDAVRAGYVLSDDGVIDREVIVPPSTINRVEKSEAIRSQRDKDLDAMRVTLVAWLRAHEAGLPAWVVERTILSREPRAVPQVDTPRAEAVRDASQRTRAWHVAQWRSAARFRALAFAWRSQRFDGDGEGYQVLEDWRYRDEHLERYESGMRRGGLLDRRERYRMLAADLAARYRTLVVDDFDLRTFAEIPKPEDESANVKPHRKQQRYAAGSELRAALLNAFGPTRVLRESSVDVTRACAAIVVDEATGAEHTCGQLDLWDHTVAREHTCSGCGATWDQDQNACKNLIGRWRERLGADGSVETARVATPRKESRSERLRRTRWKREPEAEAASTTEPHPSPSRVAPVAPATAAPTCQKSPIVTDGAATITATAPPPSPLRAPSPVVPGQSAVRANRPIAAPG

SEQ ID NO: 212 - protein, 745 aa, Unknown
  source: /note="Description of Unknown: terrestrial-soil sequence"
MEISRASGSHRVMPMCTQPVHACQCLQERATWDHVIKNYEYGLLDPTANAQLVDDQMRAAHRYYNQLVEIERERRAEIAAILVGHPDTEALAARVADLARQREEARLAIKATRQATRDRSETSQMRDRVKDLATELRAARATLKTARDVIKTDAVIVAAISACDDRATTRVKARRAACEAYWGSYKLSEEAVDAAKKAKAPPHFKRWTGDGRVSVQLQGGISDGELFGTDTQVQVAPVSPDAHDLRKPRGVRRLASRTILRLRVQSTEKGRPIWAEWPMILHRPIPEGARVKIATVSRRRRDCRRWDWRVLLTLEIPDGASEHRRLIPASGAIALNLGWCKRPEDAVRAGYVLSDDGVIDREVIVPPSTINRVEKSEAIRSQRDKDLDAMRVTLVAWLRAHEAGLPAWVVERTILSREPRAVPQVDTPRAEAVRDASQRTRAWHVAQWRSAARFRALAFAWRSQRFDGDGEGYQVLEDWRYRDEHLERYESGMRRGGLLDRRERYRMLAADLAARYRTLVVDDFDLRTFAEIPKPEDESANVKPHRKQQRYAAGSELRAALLNAFGPTRVLRESSVDVTRACAAIVVDEATGAEHTCGQLDLWDHTVAREHTCSGCGATWDQDQNACKNLIGRWRERLGADGSVETARVATPRKESRSERLRRTRWKREPEAEAASTTEPHPSPSRVAPVAPATAAPTCQKSPIVTDGAATITATAPPPSPLRAPSPVVPGQSAVRANRPIAAPG

SEQ ID NO: 213 - protein, 630 aa, Unknown
  source: /note="Description of Unknown: terrestrial-soil sequence"
MKEIRVYKHWAEPASAVDHHRLQSQLKLAYQYRRMLAMIENAARVAQRALVQADPAIAMLINQLAVLHEADPPATIVITAAQEALRLARRDLHKTDAYKLEARAIGDRRQVLVRGARGLFSAQGLAWGTYQHVEEAHDQSCSENPYWEDVKVRLTPGFGAIAVHIQNRVLPSGTLVGGRDTFVQIDAERYGLSTFRNGWRAIDPDGPSGRVQIPAGERRPCGGGAPRLQRIRIRTGSDGRAPIWTEFHMLLHRPLPPGKILWVRAHQTRVGIRTMYNIQFVVDIDTAGRAPRARPAGGAVMDDRAPQARSHHVGDATDDRAPQARSMMSHAIVGVDIGWRKLENGDWRVAMAVIPDGTTDELVVPHDVLRRADKSADLRSIRDQSRDAMRTRLLAFRETVVASLEDATPAPSADWLEATRTMHAWLKFGRFVRLRHWWAQHRFAGDEEIYSALCAWLDNDRHLIDWQEFNIRRMKRQIDGLYQAWAMRLARSFDVIAIEDMNLTDLKASSPGLVSDLAHERGMVVGLSHLIGWLKRATAGYNTRLVEVDPAYTTRNCRKCGFCRPASAELVIKCEACGFAEDQDITAGHNITARAVATLEEPTPEATPVKRRVRRTRRRPNEATTEPNNG

SEQ ID NO: 214 - protein, 669 aa, Unknown
  source: /note="Description of Unknown: terrestrial-soil sequence"
MIDRSEIDPGNRDAQLYQRGTTQLIDRLEIDPGANQGAIMKEIRVYKHWAEPASAVDHHRLQSQLKLAYQYRRMLAMIENAARVAQRALVQADPAIAMLINQLAVLHEADPPATIVITAAQEALRLARRDLHKTDAYKLEARAIGDRRQVLVRGARGLFSAQGLAWGTYQHVEEAHDQSCSENPYWEDVKVRLTPGFGAIAVHIQNRVLPSGTLVGGRDTFVQIDAERYGLSTFRNGWRAIDPDGPSGRVQIPAGERRPCGGGAPRLQRIRIRTGSDGRAPIWTEFHMLLHRPLPPGKILWVRAHQTRVGIRTMYNIQFVVDIDTAGRAPRARPAGGAVMDDRAPQARSHHVGDATDDRAPQARSMMSHAIVGVDIGWRKLENGDWRVAMAVIPDGTTDELVVPHDVLRRADKSADLRSIRDQSRDAMRTRLLAFRETVVASLEDATPAPSADWLEATRTMHAWLKFGRFVRLRHWWAQHRFAGDEEIYSALCAWLDNDRHLIDWQEFNIRRMKRQIDGLYQAWAMRLARSFDVIAIEDMNLTDLKASSPGLVSDLAHERGMVVGLSHLIGWLKRATAGYNTRLVEVDPAYTTRNCRKCGFCRPASAELVIKCEACGFAEDQDITAGHNITARAVATLEEPTPEATPVKRRVRRTRRRPNEATTEPNNG

SEQ ID NO: 215 - protein, 559 aa, Unknown
  source: /note="Description of Unknown: terrestrial-soil sequence"
MAYGHTALPAINWVYGCKRPFEGEELIRSQLRQANRYRNVLVAIERRRRTNFEQLVLRLCPELQKLETQRNNLTQEIIELRAAMKAENARQRKTVRNPESTRRIKELQAQRQLLRPRIKELRDATYTHPTVKVVDENAAAWVKRARAACGIYWGTYLVREATVKQAIKDARPGLPEFKRFTGQGAVAFQSQQGTSTALLEAGGGNNLVQMHWNEPRNRRGRRRGELWFRIGSDANRRPIWAKASISQHRPFPPDTVIKFGHLHLTKCGTRESWSVRFQLVRESGFVRTGLAAAGRVGVDIGWRRVPGGLRVAYWVGDDGREGQELLPEDFLASKQYVEELRSRRSLEFDAVRQRLATWLQMTSNVPEWLLDRTHSLAQWKSVDRLCWLVKAWAEQRFSVDESIFPVLWRWRGQSLRLKEEESHGQRKLVVRRRQLYREIALRLAQEYRTICVEDFNLQKLLTKPQVEQDAVEAGVTYHSQLAAVGELRMFLAERAADVLRLPAQGTTQHCHMCGAKSNASDKSQLVHTCQSCSAQYDQDRNAALWLLRGGVPEYAIDGA

SEQ ID NO: 216 - protein, 621 aa, Unknown
  source: /note="Description of Unknown: terrestrial-soil sequence"
MTMIRVYKYGLLRPIQNEALVRAQLRAKHDYRNTLIEIERGRRTAMRNVEEQHSELATAMAASRAALVELEESRQAIRLARSKSRSRSETNVMKERVKQARIVRRTTSQALYDCRARVRPEMISARDVINERAAELVRGARALTTSYWGSYLLAEDEVKAAAKQPLYDDSTPNDPRFERWTGEGQIGMQIQNGMTPGEVLSSEDTRLRISEPNWNDGKHVRTLRTLSLRVGSEGRKPVWASWPLIMHRPLPPAARIKRCNVSLRRHSSREIWSAELTIECPNVTSAIREEHGWGRGGGVEGAVGVDIGWRVVTDDDAGLRVCAYASEDGQDIGELRLSPHEITRLRKADEIRSIRDKRFDAIRLIVRDKLATLEVPAWLSMSTLHMHVWRSPARLVSLSKRWSKERFANDEEVFDLLESWRYWDSQHYQWECDQRTKALRRRREKYRVFGARLAEKYEVLVLEDRAEDDRTKPMDLRKFARRAQTEMEPENETARSNRHLAATSELRQALEEAFISHGGRVELAPCEDTTRTCTACGVVDRGLDAETEIDVTCSSCGAKQDQDVRASNNLCERWRKAQNAGGARNAKAAKSEGRWKKARRLRTEKQQRMGTFRNASDNSAE

SEQ ID NO: 217 - protein, 518 aa, Unknown
  source: /note="Description of Unknown: terrestrial-soil sequence"
MIRVYKYGLLPPTQNINLVRDQFRAAHEYRNLHVEIERGRRAAVRELFDTDEIRAASELLSRTNGAERLPIYKSLAALRSKRLKESSTRVDEIEELAAGLRRGARALTRCYWGSYLTIEAASDQVRKMPLYGRDGITPNDPRFIYWSGESQIGVQLQGGLTIPVLHEARDTRLRLERVSLEPARGRHPASRCRMLWIRIGSEGRAPIWATFPLRYHRELPSNATIKWARVSLRREGLREEWSCEITIDIPGAHPRTLDTSLTGAIAVSLEWTAAVNELLVARTLDCQTGEYDELRLPARMVTGLRKPDGIRSVRDKNLNELRPRLIAAFREPMAPWLAAMVARIPHWRSPDPFHALAMRWRREKCDDAREAYDILQTWELRDAHLWDYEAGSRREALRERRELYRVWSAKLSRRYKTVVLSDADLSVEARTTKEVQTDRQTAAVYELRQSLRNAFAGEESMGPGSNVQELCDRWNGEQTTGNIRNGEKSNTFEEVKGGAWAKRKSKKSSAKSILDATR

SEQ ID NO: 218 - protein, 596 aa, Unknown
  source: /note="Description of Unknown: terrestrial-soil sequence"
MSVLVYKYGLRPPIEQADRVMLEMRAAHRYRNTLVEIERGRRAAQRALLAEQPQLAPFELALTVAQAELTQAYLEIRAARQTTRRRSETEPMRVRLRETRAAVRDARGSLYLARAWLRADPALATARDRIDGVAEGLRKNARAYRGCEWGTGGLIEKADEQARQMPLYDGAEPNDPRFQRWTGEGRISVQLQGGLELAGLEADTQLRIGDGVRLPGQTKPSKHAERYRTLWMRVGSDERRKPIWAVFPLKLDRPLPTNAIVKLAVVSRRLDGPRVSWTVELTLDTTTCARRESCGHGIVGIDLGWRVFGDEIRVCAWDGDDGETSELRLHGRLLSGLSRADDLRAVRDKNFNAALAAYLAWTDRQGPLPAWMRPRGIHQWRAPGRLAGLCLRWSRSRFAGDAVGFDALDVWRRRDLHLWWYESGQRRGSLAARKDLYRRFAAWLARRHDTLVLEDFDLTRVSFKGQANAQANANRHRVATSELRLILIHAFKSRGGRVVMMNPYMSTHECPVCHAVTAFDAAAYVTYSCLGCGASWDQDESAAKILRERGSDVGDPQSARSENGPDSGGLAESRWAKAKRMKREKEAARNETGKGA

SEQ ID NO: 219 - protein, 521 aa, Unknown
  source: /note="Description of Unknown: terrestrial-soil-agricultural soil sequence"
MSLKVYRFGARMPLDRDLVVAQLRAAHDYRNELIQYERGRREAMRALYDTPEIRDAEALLKQATKSDRKAAKRALYTLRREVLEARRDEAQAINALHHELQLGARALTRCYWGSYLDVESAMQQARAAPLYDEDGLTPSNPRFLRWREPMQGQIGMQLQASRPLTTADAMRGADTRVRVERRDGPYATLWIRVGSEGRAPVWARVPIKMHREIPNAATWKWVRVSCEPRSLRDNPEYRETWSVEITVDDPAPRARDLDTSRDGAIALSWSWDVLANESIRVASYVDTFGRRGDIVCPASIAKGIRKPDGIRAVRDMVWNEEQKEIIHRIKRNANAPRWLVEAANTMHLWRSIARVHELARRCRIEGIAEGPAYEALHKFVERDLHLYDYEKNARDEALRERREWYRLHACWIARTYRHALVSDHDLSREARWGDESDVRFTAAPDQLRGAIKNALGDDAIVAYWDHEPEWCERACAAYLVGGARGEMFAERKEKTSNAWAARKKKKTETMTARKEAANASE

SEQ ID NO: 220 - protein, 573 aa, Unknown
  source: /note="Description of Unknown: terrestrial-soil-agricultural soil sequence"
MKRKKSQDESINWKYGCKSPRGEGAEILRQQMREAHNYRNKLVELELLKRQEFYDLERELFPEYADLQEQEKQQADKVEDLRKQWKKANARARTRTEQHLLKAQIAEEKQTLKDLRARMKEMKEQVRNSEELKERSKQIKKRHYQRLKDLRAETPAFWGNVGFVDQAAQSMASGSPPKYYRWEGEGFIGVSFRTPITPEVLMSGRNTRAWLEPCKTANNKAGRVKKTTLHIAVESENRKLKMASLPIYFHRDFPDGCEITSVRVFCKKVGQREEWSAVFQLRSASFAKPDAAADGMAAIHFGWRRVDDGLRVASVVDEDGTEEVLILPESIIDSYAYVKDIQAIRDYLWNETIAILSAFLKQHSDSLPEPVKEASQNMHLWKGRGRLVHLINVWSDHRFPGDEEMFLKLTRKGTPANEYHDSGWLHRDKHLWDIEANVRDNAALRRKALYREFAAKMRRKYRHLITAKLDLKKIVSVKNPEEEDDAAMKHHSRVAAIHSLQAALSDSMRDGWIVVPAAKQASTCHECGAKFQDDSGDAYISCENCGSTFDREFNACKNLLFGPKQVNAAPALV

SEQ ID NO: 221 - protein, 618 aa, Unknown
  source: /note="Description of Unknown: terrestrial-soil-agricultural soil sequence"
MAKRQREGTEALVYAYGLLDDQPELYSDPNVAAEVQRQRDFWDLLVRLEQEHEERVYQYLDEHAPEYRAAFEALCEKRRELDRLIERKRRERAEAKQKVEDPELDSAIKNATRDWKLAQKEMWAALKKARREHKEALAALRAEFYARIPKCKDSPLFWANYNRVRQSFDATLKRVRKQGQTVRFSDPHRDDVCLTVQIQKVRGVVGCSFEDLLSGRVSQLKIAPIDEAAWYTTRANRRRLCRTEVTMQVDRAGNTVRALVAVDRPVPPEARIKSAQLVWRRVGERYVGKLCLTISMPAVERTNGSTAACGIDVGWRRTDDGGLRVATIVDSSGNVDHLELPADWMSGMDQVKRLSQYLDDAALDIATLLLGRDDLHPAIAAAIKRWRPGLGAGHVNVAALRDAVRELGFTGLPAELCCGVRSWRDRKERCCWYHRHIHLSTWRDNLRRKLLLRRREIYRLAALTLAERYAVIGIEKLDLAKMAMTKKREDGSDPTLHSAARAQRQRACLHEFRTELEHQARKRGARLELVDASKTTITCHECGAETQPTRRDRMMIHMACDSCGAVWDQDVNAARNILLAAIGASGDMTPPDDDGGSGAYKRHSEEISDRSQLGAPLL

SEQ ID NO: 222 - protein, 672 aa, Unknown
  source: /note="Description of Unknown: terrestrial-soil-bog forest soil sequence"
MNILVYRYGLRAPHENRDLALSELRSSHEYRNKLIEIECARRKRVRAAEDALLGKPRLKLAEAQSALDAAIKAVSKHRAETRKRTTPAEMLATLKAAREAQHAASKAFRSARQLVQPRCSDCRKKDLPTPCEHATPEGVGLLAELDAAQDEAKESIKKFRNESGPFWGSYLLVDKAAGQSFSELALYDIDGKPNDPSFLRWTGEGTLGVQLQGGLSVEAALAGQDTQLRISSPPVACWDPSTGSRKARSRQSRESEVWLRQGSVGRAPIWCKFGLHMQRPLPPGAQIMWAEAHCRRVGPHFDWYLTLTLKVDDAVALKPRIIPTRDAVAIDVGWRVFGEGETHELRVAYWSDGSNDAPVVIREKDIRVPGFVIPPRGELRLDTATLNQLTQPEGVRSERDVLFDGVRARLIEWLKTPHENEPEWVDSDGVVVTLREHCKALHAWRSQAKMAALTSRWGEWLKEHPDGDKWAYDMLVAWRGQDRYLWAVESRWRDRARLRRRELYRLFGVALARTYGTVVLEEFDKREIAKRPKTEDDGEAHPARSNRQLAAVSELCECVAEAGTSRGRNVVEVPCENSTRECPVCGCVDERNAARKVTISCACGHVWDQDDGAADTLLGRWRKRPGDAKMAGAPRKPKILNGDGSVENRMQRAKRKGAEKALRKMELSKTTT

SEQ ID NO: 223 - protein, 561 aa, Unknown
  source: /note="Description of Unknown: terrestrial-soil-bog forest soil sequence"
MTTRVYQFGLRPPIEGIDLVRAQLRAAHHYRNELIAIERGRRSALRQMDDTEEVRKAAGAIGGTAKADRRKAIANLRDARRRARESKPEEFKRIAEREHEMLLSARANTSCFWGSYLDIESAHRQARSAPLYGDDALEPSDPRFIRWTGVEPPSGTYPRLPQSGEGQIGMQIQKKGKSSENGKSSENGKPSEEKRRLVTSDVFACLDTRVRLKRGGAKDGDPRYGFLSLRVGSEGRAPLWATWPIKISREIPDAAEWKWVRVSLRHEGRRERWSCEITVNDPAPAARSLDSRLRGVIAVEWEWSKLEDDSIRVARWADSMGETGMVELPGSIAKGIRKPDGIRAVRDMISHELRPRLARLIREAKGPKPPWLVAAANTLHLWKSPRRAYELAERWTDPTLLPTARVVLFEWRARDEHLWDYEAGARSEALRERREFYRLLAARWARRYQSIILSDQDLSREARWGEESDLRFTASCCELRGALRNAFGPDAFDGKYARSEQEDWQWCEQARDAWMAGGARKDAMCAKRKEQTGNAWAKRKAAAAAKRAEKGSACEPPGKSV

SEQ ID NO: 224 - protein, 628 aa, Unknown
  source: /note="Description of Unknown: terrestrial-soil-corn, switchgrass and miscanthus rhizosphere sequence"
MPVIVYEYGLSPPKVNAAIVEEQFRLAHKYRNMLTEIELERRTKIRAIMASHPDMVPFETELAEVQAEIEKLRGEINAIRMAARKRSSTPEQSKRIKTLAARARELRTEIKERRKRVATELAPDLKAIQDAAVQRRKDERAKSGVYWGTYLLQEAAADQARDQPMPPKFTRWNGDGRVSVQIQQGLAKEGLWGESRQVQIATRIDSLVYDHEVTRRGDRRRLYRTTLRMRVGSTDRQPVWAEWGISMHRPIPDGAVIKVVTVSRRRCNSTQWWWRVQFTLDTTDCKPRQRPEYGVVACNLGFSQTDSGAIRAGYLVGDDGFEQEILVAKSDLYRGRDLTPEQKQKAMTYVRDCLAESSEIRGARDKSLADFKTRFLEWYQIAKATTFGEDAVPEWFRDRMEHFHLWRSPARVREMMLHWASNRWAELDDPESRWPDSRGLEMMSTWVDEDTKAEVKESSLRNKALGDRREAYRIVAATLAKRYKTLLIDDTNLKHLQDGPEPEDAEGDIPAVKYQQRLAAGSELRQVLINAFGGTNVVKMKPSNMTVTCSGCGARDVSWDRADGFRKHRCSACREIWDQDANFCRNLLKEYASGGEAPAAKIAKPSRSQRFHESRKKKAAAADQQEQG

SEQ ID NO: 225 - protein, 690 aa, Unknown
  source: /note="Description of Unknown: terrestrial-soil-corn, switchgrass and miscanthus rhizosphere sequence"
MPKKPNPNKRVSSDTRGARIWSYGVLFPREREVNDAIRSLLHQANRYQNCQVVIERVRRQRYRVIRSAASPELARLEQEYKDLGLAIDAEVDTMRAQRASVRRRTTDPVIAAKIKALKAKRAAVNIELKIAREKANAILRPIQDAYNRHRKPGGVKAAPRTAEKLNAAARQTTLEEDWPELAKQLLRLEDWATRRVKQAREASGLPPGTYLLVDQAIAATKKEPTDPRPKRFDGTGRIGVQLFDFTPQTLFSRERKQLQIDPLPATQWDTRPGRRKARTELRIDFGGNAFEMKAAFKMILHRPLPQDASIKWAWIHVTRIGSRLHYSLQLTMRSDTFQLKPGGQGVVAVNLGWRIKEDGAMRVAYVMDEFGTERELAMPPELRGGFVLAENLRSYSDQHFNVAKKAIGEFVKTDAAPAWLKEQCTSMHAWQRHGRLLRIARMLAIAEFPDTVLPSGERVRNGMLSELWKRWKEHRLAAVPKLDLFDTYQVITDWARARGATDLKAATLYLWVWKKKNDHLYNWECGLRAHKQKCRKQLYRAWATELATTYSTILVEKFDLRDTREKSAPEAEQEENPTSLIRSQNFAAPSELRDAIVAAAGTGRVKEQKSHNNTVTCHECGHTSDRDRRFEALIQVCESCGVVKDQDKNNCENQLSRYFSGESPGGGLDPESARNHENSSDLKTDRDAAE

SEQ ID NO: 226 - protein, 630 aa, Unknown
  source: /note="Description of Unknown: terrestrial-soil-fen sequence"
MKRKTSPIPTKVYKYGLLAPVENVKLVDHAFYLGGKFYNKLIEIERTSRNEYRQERARRFPNHDKVEKLVATLSDQKKKLSEIIKASKIATKSRNVPPELATEYKTLAAAYKSAKLRQDAEREQCKKDRDFSAWTLTHNEKKNALVADARKNSGLMWGTYNAIAASVQQAGASAILDPEFKSYRGEGRIVVQIQGGIYLAELGSDTQLQINLPNLNESLTRGEWRQSSRTIVKMRIGSDKHKKPIWATFPAVFHRPLPSDARIMSATITRRRLGVFQSSGRYEYHLCISCESTMFDNEAVRPRLQDPTQQREVREHRGTSTINFGWRQFDQGKDKRLRIAMTNNEVTGLEPLWLPREIILGLQKCENLRSIIDMKFNEVRALLTTWLTPHKQDCPAWLAESLQFLHTWKQPDKLDRVVANWGSGMRFPADADIYPVLAEWRTKHRHLSEWMMRQRRKSYNHRDDYYLKTAARLAQSSSRMVIENFTISKVAVKPGPEVEKTGGNEARHNRTLAAVSELRSALIHACSKHHCPMDITPAVNNTRRCNVCGKLLDWDPAIKVDRQCPECSNWDQDVNATDNTNDKVASGDVVTMVVPAKTSENGEFEAGTISTFGSARKRLHNLEKTLTIQE

SEQ ID NO: 227 - protein, 674 aa, Unknown
  source: /note="Description of Unknown: terrestrial-soil-forest soil sequence"
MPVTALPDGTISTARYAARGPVPAPVTEELRLGNWLDNLLTEYELDYEAAKAAAWEEDPHVALLLAAVTAAEQAWQAARDESAACKQKLGYAKRTGTPARIAAAKAAAAQAQQAYRAAVKARQEAAAALRDIKGLRWHVAKAAINAAAEERDRKIAATYGPYRDRGGYWANWAEHAKHHKTAAKRVRDMRKQGQPAQLRYHRFDGTGTVVVQIQRELGVTPEIRAQVTALKAAGRTPGQIKAETGVRAMTAAKMKPEGAVKEGDPPCTAAALADETGKWRSSVRLTPELPAGFEELPRGERRRIASQGMFAIRTGSAANLAVSVVPVTVHRRMRGDGDVKYAKLTVTRNGPDKDMSVSLTQRVPAPQPRAGGRLVCVHAGWRALPDGSLRVAVISGAGPLTPGLAAPGGRDARAGELTGVVRDLGDGCHEVVIPARWRDQDAATAKTRSVRDLARDTAIAAAADWLAASPRYETTDGEPLPAAHEVRRWQSPGRLAVLGQRAARGDYGDDAAGLGELIAGWAVPDLEAWRREARGRRHLTRRRDDAWANVAAWLCTGTREVRVDEWDIRAVTRRPGPGETDDPQAAAARANRTLAAPGALRQRLTITAVLAGVTVTVLDPPDAGSVLQVHAGCGGVLDRDARRESIVVQCPGCGARVDQDVNMVRLMAARQPSA

SEQ ID NO: 228 - protein, 600 aa, Unknown
  source: /note="Description of Unknown: terrestrial-soil-groundwater sand sequence"
MEDAMEADQTPATAEPAAGAVIVYRCGLRAPLDWGRDCDDQLYLMTRLWNTLVEIEHAHREAYFAATASDPVVAAIEAEITGLERLLEQLYAQRAELRKAARKRVRTPELDERIAELKAKLKARRAEAKEARKAARETIKPQLETLEAERREAVKVARNASGLWWGNYNAVCADYDRARSAVIKRGGKLQFRRHDGSGRLVNQIQGGMSVADLLGRAHSQVQVTGGAWAVNARGHLTATVYTRTAAAARAAGAGGTRRTVTWPLQLRRPRPGPYAQARIKEVVITRRRRGHKFDWHVSFLCQLPATEPALPAGRACGIDVGWRRLNDGVRVGTIVYSSGEREFVVLPERLVAAARRAQDIASRRDKIFNDLIVSWRAIDWTNAPEELAATAVRLQKSKLSPPQLHGLVYAWRRHPFFAPDAFTVADRWLAEDKKLWETEASLARHVSNARRDLYRGAAKRLVATCGLIGIEDIDLAALARRKTPAGGDNEIAQATAWWRRIAAPGELLAAISHAARRDGALIHKHSGKSTWICAQCGTESMPSDRSQLVHTCPHCSHTWDQDVNAARNLLAAALASAPVTLDGPAALAWEKPRDPNDLEE

SEQ ID NO: 229 - protein, 604 aa, Unknown
  source: /note="Description of Unknown: terrestrial-soil-groundwater sand sequence"
MEDRMEDAMEADQTPATAEPAAGAVIVYRCGLRAPLDWGRDCDDQLYLMTRLWNTLVEIEHAHREAYFAATASDPVVAAIEAEITGLERLLEQLYAQRAELRKAARKRVRTPELDERIAELKAKLKARRAEAKEARKAARETIKPQLETLEAERREAVKVARNASGLWWGNYNAVCADYDRARSAVIKRGGKLQFRRHDGSGRLVNQIQGGMSVADLLGRAHSQVQVTGGAWAVNARGHLTATVYTRTAAAARAAGAGGTRRTVTWPLQLRRPRPGPYAQARIKEVVITRRRRGHKFDWHVSFLCQLPATEPALPAGRACGIDVGWRRLNDGVRVGTIVYSSGEREFVVLPERLVAAARRAQDIASRRDKIFNDLIVSWRAIDWTNAPEELAATAVRLQKSKLSPPQLHGLVYAWRRHPFFAPDAFTVADRWLAEDKKLWETEASLARHVSNARRDLYRGAAKRLVATCGLIGIEDIDLAALARRKTPAGGDNEIAQATAWWRRIAAPGELLAAISHAARRDGALIHKHSGKSTWICAQCGTESMPSDRSQLVHTCPHCSHTWDQDVNAARNLLAAALASAPVTLDGPAALAWEKPRDPNDLEE

SEQ ID NO: 230 - protein, 525 aa, Unknown
  source: /note="Description of Unknown: terrestrial-soil-palsa sequence"
MIRVYQFALRTPVDNEPLARAQLLAAHRYRNQHVAIERGRRWAVRLCEASEEVDEAVALVQSATKSTRKDALKDLRAARKAARETHADELARIAELDAEIRRNARSHTSSYWGSYLTIEQSSDQVRRMPIYEPDGLTPSDPRFVRWTGAGQIGVQLQGGALTPDVLAGRDTRIRLIDGVLWLRVGSEGRDPIWAKWPIVQHREIPSGADWKWARVSLRKEGPWERWSCEITLEIPGEHPRNLDKDPQGAIAVEVTWDKPGDALVVARWRDDAGRTGTIELSEYDEQGIRKPDGIRSVRDQLLNDLKKRLPRAYAECRGDLGPPWLGEAIDGAQYWRSQSRAHTLLTRWRAEKCDAARAAYEILDAWWLRDMHLWEYEAGARGQALRRRREKYRVLAVTWSREYRHVILDDRVLSREARFGDASDLRFTAGPSELRQCLEHAFGGRNGGNVTTHPVRDDAAKSETEERDWCERAIDAWIAGGARATKKVSESTGVKGGAWSLRKSKKSQKQAENGTAREPVAKGAV

SEQ ID NO: 231 - protein, 643 aa, Unknown
  source: /note="Description of Unknown: terrestrial-soil-palsa sequence"
MSKFRVYQYGLKAPTENAELVREQMFLAHRYHNTLIEIERGRRGAIRTLTRGHNATIRQLEADLLEADALVGKIVREIKTQHSETRSRLSTQTDKEELKVARQKKKEIKSQLIEARYLDKNNPSIINERTNINDLAKEAIKSARKHCGVYWGTSQLIDDAVEASRKMPLYNGEKDNDPSFKPWKHQGSVGVQIQKRDDIQGMDVKNVFGADTCFRIDCVNEGAFYAEKRGDRRKQRKTTMRMRINSDDKGKPIWSYFPMTMHRPLPDGGIIKKAKVRLKKIGSREEWSLSITVDMSNVLMTTNNNHEAVAIDIGWRDMKDDNGQTTGFRMCKSRGTDGKIEEIKLDPKIISAIKKANELRGLRDDNFNKERASFVAWAKVNVLPDWLVKETKTIAQWRSISRLVKLFKQWKNNRFDGDEVIFGVSGKWNKGDKSVITGTGLAGWAYHDFHLWNWEANQRTKAIRRRKEFYRVEASKLAKQYQTLVLEDFDLSDVSQTAEPEAEDDNQRGRSNKTISSPSEFKLALINAFDARNGKIEKVNPKGTSYICHLCKSKEHLDSTFHIHTCSKCHQTWDREDNATANILTLWRERLSDEQNAVSARKDENGNENKGVEETRYQRRNRAKQEKKARLETARNAEANIAE

SEQ ID NO: 232 - protein, 640 aa, Unknown
  source: /note="Description of Unknown: terrestrial-soil-palsa sequence"
MIKTEKYGLLSPTLNADLVLLEMRKAHDYQNNLIEIERWRRDEIRKIESIYGNIPQLTIDYDIASNDYETILKTKKKNNSNARANVSTPELNQQLKDAKSKRKACENKLKQARLSSRKDDKIKKAKDNISILENKKQSLLRKSDAAPWYGTYMLIDHAFGIPSAKGKTKGMPLYNGINPNNPIFRNYNGEGRIGIKQFQPYEPINKIININPTSKFLQIVPIPPPKLKKDGSQRKIGNKNLKLLRIRIGTGEKNAPIWAEFPMVYHRPLPSNSVINMVQITKKIIASREKWAVSISYEDNIQFSKNEIKKVVAFDLGWREFPDRIRIACWKDNDGKSGEISLPIGLGIKKDSNDKIIKNKDGNDKLFHSTINKLRKVKELKSGRDLDFDRVKQLFGYFVNSGIIFPQWFQDWLNTTNKNGKKINDITYISKWRSQTKLSKLILQWKNNRFTGDEDIYMWLEYWRYHDFHLRDYEYNLRNKSIGAIESLYKNTAAHYANNYDAAIFEDINLSNIAKGKVGSTNRQLTAPSKFRNACKNAFNMRGKCYEEIIARNTSRECAVCHVLNDIGGKLEYFCSGCNVELDRDENAAENILERGRKKLSDNNTYIDSHENCEHDSNAKNAVGARIDENCNENNNLQYA

SEQ ID NO: 233 - protein, 552 aa, Unknown
  source: /note="Description of Unknown: terrestrial-soil-peatlands soil sequence"
MTRRVYQFPLRAPIEGAALVRAQLRAAHEYRNDLVSIERGRRSALRAVDDVPAVREAIAVVLAATKSTRRSAIALLRDARKEARAKAADELVRIGVLDAQARRDARAITPTWWGTYLDIEAAHNQARSAPLYEPDAVTPSDPAFARGPRLGREAFAPDDARAAWWLGDGQIGVQLQKGLPTPGALAGADTRVRLVLRPADHPRDRYGTLWLRVGSEGRDPVWAQWPIKLHRAIPDSAIWKWVRVSVAREGTRERWSVEITVDDAAPRPRDLDRSLAGAIAVEWEWSLLDSGAIRVARWADTRGGSGELLLPERIATGIRKPDGIRAVRDLELNALKDSLQQALREASDVATPRPPWLADAASTLHLWRSPDRFRGLLYRWQRERYDGARSAYEMLEAACHRDDHLYDYEVGARRGALGARRDLYRCVAARWSQSYRTVLMSDQDLSREARWGPESEVRFTAGCFELRSCLRNAFGDADAIDSRWRDAPGEQEDREWCERTRDAWSAGGARGDGRFAIRKEKTTNAWAARKAKSKAKRGGDEASRDPDGKGAE

SEQ ID NO: 234 - protein, 622 aa, Unknown
  source: /note="Description of Unknown: terrestrial-soil-pond soil sequence"
MAGRKKKDAPPSRVWIFGCGEPVDGAELVRDQLFETHRYRNDLARHVLNSRQVYREARSEICRVAALEQEHLEAKEALDVLRQEQKAWSAAARRRVQSPELQQAIKDAKQKKRDVLERLKQAREEVEQDPELQQARAEINKRAAAEKKRLYNESPAVWGSRLRVDESWLQMRWGRMDPKFRRFDGSGRVVVQIQKGMSVAQAFECKDTRFQLARPTRDWDRRTGRRGGTRTMFRIRVGSEGKRRTPVWATFPVTLHRELPEDAQIKWVEVRAVRQGPDLRFQLHLTLEWHGFDPRSRGAGAVSIVCGWRAMHDGTVCVGRWIDDSGRSDVLVLPADVGEAEKHASSLRSISDLHFDAARRVFKSRRHLLPAWVTEESAYLDKWRSHARLAKIVGRLTAEILGDEAAHVWRQWRRYRQREGLDLHAPYEELSTWLSEQGEVDPARQTAFYLEWWRRKNRHLHRVECNVRTKALRRRKAIYRNWAASFARRYETVLVDDFDLRQFARNAAPEEDARQDYLHGVMRLAAPGELRLAFLHSLGGARAVKVPATEGLRRCYLCGSPMRRPDRSGTVEHDCGVITPWQTIRGLDMLRGAGVDTVAAEQKLLEGHEAMKKLFRELARKG

SEQ ID NO: 235 - protein, 701 aa, Unknown
  source: /note="Description of Unknown: terrestrial-soil-rice paddy soil sequence"
MSETDTMAFKFRILRIVSDEARIKREIREAHQLYNDLVAIERKRRDDTRLFWADRGGYADKLAGLRAAAEDAEKAAALTAKGDAGKKERQEIWAPVDTLKREIWELQRKTEEELSDPAKVRRKQRARELQAEAKARAGKALKKEALAALLDAEPDCMSPRDRRRLELVREYEARGVAVSGKAVAQRLRDEGLVGPTEQIEEAARKAGYEAYLKRGVSPGTRAIIADAFERSLEDLEPWATQRFSRWDGHGSFGVQVQGGSLTEEVYSGEHTQVRLRRLEDTGKHREGSRRSGRRHELRVRIGSDGRAPVWAVFEAIVDRPLPPEASIKRVVVTCDRLGVLDIYHVVFTCSVPSSVYHKRSGEQRGTVAVDFGWRSLGGEEMRVGYWVNDRGESGEIRLPGVGVARRGTTGKNSPYEPKIRGQVPIRQLDKHTRDLTEIMAREFAEYDGGKICGGALRDVASWLSANVSIVPEWLTERTTGIHVWRSQHRLYWLAQDWKAQRFDGDAEIFERLSAWASDWAHLAEWERRQHAAILAARNEHYRLVAVGLAKKYERIVINGADFAAAKRRKTKDETDRLVMIDDRSRSQAHLAAAGELREEIVRSAKKWQAIVMKAKPNKATCHACGSTCVYDAAKDLAHECEHCGVRWDQDENCCRNMLCEWSGDGQTAGGARVSPNAKKSGEVLRSKKRDEDGGPIGEAAE

SEQ ID NO: 236 - protein, 739 aa, Unknown
  source: /note="Description of Unknown: terrestrial-soil-surface soil sequence"
MSTGTVPPAAGNTPPTGEVTVARRYGAKPGPIPAAIREELDRAHWLVNRLVEIDRECDEQVTAVWEADPQVGPVLAAVRDAEDARAAASEELRRAKVKLGAVKSGRSRTGLDVARARVDAAREAVRQASAALKQARDRAGAVKQERWPAAAPVIRAAQEARDAAIRATYPEFVARGGYWATWNDITGAHKRRRDRVQQLRRQRRPAQMRYKRRDGTGTLTVQLQRQLGVSAAERAHVTGLRDAGLAPSQIAALITAGVPAAEVTPARVARLRAAGLSAPEVTQALVAGADPAAAAAASRTPGKAARRAALGEVLAAAAAARPPRTPGRRWRPQSVARVRAGGKDTPGDPPFTPDVLAGPAGPAALQVRPVLPPGYPQLPRRQQRALARQGEVVFRTGSAANAAYTTIPVVLHRPLPAGGDVKMGRLTVTRCGPDLEQSVSITARVPAPPPAAGHTAAVHIGWRALGDGAIRVAVITGPRTPPPRQLAEAGVVRPVGGCWEVVVPPRWQVALTRVDGMRSARDREWQQVRDRVAAAIPPGHDTLPPPAQVRAWRSPGRMVTLAAACEAGEHGGHGRAIADLVTPWARRDRAAWRNESRARRRILRRRDDAWAVIAAWLTAGAGTVIVDDWELPPLGRRPGLTEEDDPQWRAARANRVLAAPGALRARVRVTAELAGVAVAEFPVPRPGQAHAGCGHPLDPDARREDVLVPCLGCGVKVDQDINMLTLMLDGAREGAPQAG

SEQ ID NO: 237 - protein, 615 aa, Unknown
  source: /note="Description of Unknown: terrestrial-soil-surface soil sequence"
MTAYSYGCPAWAVPLAPRETDPVTVIAALAGTAQALRQAQAALPGGGEREWKRWAQALQARDQAREAVWVTGEEALAGQLRLACRLWNRLVEVTRGHERARAAVWASDPAVAAAQETLDAARAAVAACHERIRVSRQADRTTVPRDADKQALDEARAAARAAREARDAAREAAFPRLRARFAAAAQARLAGVKAAAAEATEAGLGWAACNDITWRRFPAALQKVDRERAAGRPAELRFRRWDGTGTVTVQVMGGAGIPPRTLPALNSGRHPRSAVMRLQPWRDPSAGRPKGADRHGTLTLTAGRSRRHGPLRLQIPVVLDRYLPADADIAEVKVTRFREGTRHRLRVSAACYVPAPPGPPPGGATVAVRLSWRAAGGGWVTAAQVGSSSPLPPLPRSLEHAVRGTAGGPRLPLVRVAPGSLSAEVLYYAGWRRLLERGEAIQAVRGQNTDILREKVTAALRDDPALAAAVKVTAGEVARWRAPRRFAALARRWPAGHPLRPLLEEWRRRDRHLQDYQACETAQVLAARRDAWRCTAAWLCAGASAVVIDGTRLDAEKQAPGDDEEDPEGARGARRLLHRSAPGELRAAVEAAAARRGIPVTILKAAVEPAAGGGA

SEQ ID NO: 238 - protein, 628 aa, Unknown
  source: /note="Description of Unknown: terrestrial-soil-surface soil sequence"
MTAPGGEGTPARVMTAYSYGCPAWAVPLAPRETDPVTVIAALAGTAQALRQAQAALPGGGEREWKRWAQALQARDQAREAVWVTGEEALAGQLRLACRLWNRLVEVTRGHERARAAVWASDPAVAAAQETLDAARAAVAACHERIRVSRQADRTTVPRDADKQALDEARAAARAAREARDAAREAAFPRLRARFAAAAQARLAGVKAAAAEATEAGLGWAACNDITWRRFPAALQKVDRERAAGRPAELRFRRWDGTGTVTVQVMGGAGIPPRTLPALNSGRHPRSAVMRLQPWRDPSAGRPKGADRHGTLTLTAGRSRRHGPLRLQIPVVLDRYLPADADIAEVKVTRFREGTRHRLRVSAACYVPAPPGPPPGGATVAVRLSWRAAGGGWVTAAQVGSSSPLPPLPRSLEHAVRGTAGGPRLPLVRVAPGSLSAEVLYYAGWRRLLERGEAIQAVRGQNTDILREKVTAALRDDPALAAAVKVTAGEVARWRAPRRFAALARRWPAGHPLRPLLEEWRRRDRHLQDYQACETAQVLAARRDAWRCTAAWLCAGASAVVIDGTRLDAEKQAPGDDEEDPEGARGARRLLHRSAPGELRAAVEAAAARRGIPVTILKAAVEPAAGGGA

SEQ ID NO: 239 - protein, 607 aa, Unknown
  source: /note="Description of Unknown: terrestrial-soil-surface soil sequence"
MEKRESTVVTIAPVRMCGTTIRVYRYGLAPPLDWDDECDAEMARLDRFYNALVEIEEAAQAEYRRLSSSDETALLETRIAAAEEAKDWGAAKALRAALKEIRAALRKANAAAIDAAEEKRKADAKAARQNCGAYWSSYNAVIRSVELARQKAIKEGAAFGKRTHEPGKGDWRMTVQIQGGASVADVLGGKNSQLRIAAPAHFGALRDRPAGMSRKACRHGRVTMVVHNTGGLRRVTWPLMMHRPIPPEAIIVGAEIVKRRRLGSRWDDWHLCVTVREPAPAPHESPDCAGVNIGWRRLSVERGLVIDGAGLRIATIWDGATLNHVILPEEIISAAWRCDELTSAIDKRVDAATARIFKDSPDHPVARQLGDTFVESGRLRVRDLWTFANAMTPAPDWLLAMLRACSRDRRERAGLLRRMARRRRDIYRVAAKTIAENYGRIAICAVDWAKLARLRESGKDNPLPPPARGYRKIAAPGEFEAELRRAIKARGGTIMDIKDSVSFLCHACGKEHAPSERSAAHHTCPSCGATWDQDRNAAMNLFAALDSSGPAAIKPADSLENGKGEMQSTAYVGRFQRRAKQAQEAKLANKEALENASELVDETIGCK

SEQ ID NO: 240 - protein, 520 aa, Unknown
  source: /note="Description of Unknown: terrestrial-soil-surface soil sequence"
MIRVYKYGLLPPTQNINLVRDQFRAAHEYRNLHVEIERGRRAAVRELFDTEEIRIASELLSRSSGTERLPIYKSLAALRSKRLKESSVRVDEIEELAAGLRRGARALTRCYWGSYLTIEAASDQVRKMPLYGRDGITPNDPRFIYWSGESQIGVQLQGGLTIPVLHGARDTRLRLERVSLEPARGRHPASRCRMLWIRIGSEGRSPIWATFPLRYHRELPTNATIKWARVSLRREGLREEWSCEITIDIPGAHPRTLDTSLTGAIAVSLEWTAAVNELLVARTLDCQTGEYDELRLPARMVTGLRKPDGIRSVRDKNLNELRPRLIAAFKEPMAPWLAAMVARISHWRSPDPFHALAMRWRREKCDDAREAYDVLQTWELRDAHLWDYEAGSRREALRERRELYRVWSAKLSRRYKTVVLSDADLSVEARTTKEVQTDRQTAAVYELRQSLRNAFAGEESMGPGSNVQELCDRWNGEQTAGNIRNGEKSNTFEEAKGGAWAKRKAKKSSAKSILDATRQG

SEQ ID NO: 241 - protein, 670 aa, Unknown
  source: /note="Description of Unknown: terrestrial-soil-terrestrial soil sequence"
MAFGNVAKPSRIYTHKSRPPHEGAQLASDQLYRAHQYANALIETERQRWNATQDLMRSMFPRIAELEARIDAINAAIEAKNAAVKHQNQAARSRTATAEDRAEVKQLQSERRDAAKELTAERHRQTGVPKPRKEAWERIHAVINATTRDEKERKALRKAAQAAIDAGESPAPLTAEEDREAFGDPEYRRRRAAIDETANADRRAKRAVCEVYWGTYLCVEGAVDKSVEDCAKGQPVRNGKPPVPPGPPRFRRWSPEGKLGVQLQGGLSWLDALAGTDSRLRIELQPLAARPTVSKSGKPLPLADPNSRRSRENSQVVVWARIGTEEDGRSPIWMKTVAHLHRHPPADAVIKWVYLQRNLKGVQTWWEAQFVFEREEGWAKDRETLRGEAAIDLGWRKVADGLRVAVLIDDDGERMECVLPDSWLESWAKAQSIQGFRDTEFDAIRPALVHWLKARREAGTLPEWLGEATGSLHQWKSCERLGKVVWQWKDQRFDGDEAMFERLVEWRNRDRHLHNYARGMEETAVRRRDEHYHRWAALVRRRYALVKVEDTNWREMQHRPEATDDGKNATIGAFRCAAVGRLLETIQEHVWNVVAVEPAWTTKTCHACGHVDDFDSAKELVHTCSACGEIWDQDDNAARGLLKGRVLKWLTREGRKLPKAERVRDVEAAV

SEQ ID NO: 242 - protein, 675 aa, Unknown
  source: /note="Description of Unknown: terrestrial-soil-terrestrial soil sequence"
MFGHESKPSRIWSFKARPPHEGGGLVTEQLRLAHRYRNALVALARRKHEDTEAALLRYRPRLGTLFGLASSLSEAFSAAEDSVKARSVAGRRRDVLRGDERKAHAELRRAKEGAWAAYRRERSAAFRVPAVRSELDAIDAAFYSGWRAARGVAVNEWGLYWGTYLPAEAAFNQSLKPPGAGKDDASVSAKENIRKRWGPPEFRRRLRGEEFVGHEGAVTVQLQGGLDWYAAKLGNDTKLRILPVPAGLTPTTVTRPAFTRAERDRIKRLRREASLVRKELGRLGTPADPGGGDIDGRRSKLVAWGHSVRGEIARIRAGATLRTTPLPPPDPGSKRSRAGRRAEVWVRVGSRGPAGREPAWARAVAYIDREPPPGTVIKWVHLRRTLAGRSARWSVQFVLSRDSWDAETAAAGAAGVDVNWWMTPVGLRVATAAGSDGSVSHLFVPNDVVDAWRKHESLQSIRSVNADAARAHLLAFRSSGVRLPGWFREASAYAHAWKGGAKLAELVWAWKGRRFPGDAVVYARLEAWRKQDRHLHDWHGAQHDKVRRIRNDLYRKWARGLARRFRLGALKDTNYAAVRRAAPAGEEDKGFTRLYSGIASPGLLSRYLREAFAECAELPANNVTRECHGCGMVNAFDQARVRFHACQGCGASWDVDENAARNLLRRAAGARREAI

SEQ ID NO: 243 - protein, 674 aa, Unknown
  source: /note="Description of Unknown: terrestrial-soil-terrestrial soil sequence"
MPTKVYTYGAKLPIHGLELLDDSIIHGHRYYNALIALNRARAEKIDALRHQLIPGLDDAEAAVVAAESGLEDLRAAVRQRNAERRTKTATPEDRQAIKAAVASLKEAKAIRKEIRSRCRDCVEYKESLDKVWNDFSEASKAAYNESPCWWGTKLHISQSVERAVESSAKIGGVPRFRRWEQVRFDPAAGDDGAFVGAGDGVAAVQLQGGMTVEELLAGADWRLRMEFVADGKRTSLRAARKVIFSLRLGSDGREPRWVRIPAYYHRGGELPVDAKIMWAMIVRRALAPRRQRDGSWRPWYEYSVQLTVRTGEARPTADGGICGVNLGWRTKPDGSLRVAVAVGGNQETHECVLPAHMLAGWKLGETLQGHRSVNFDRIRAVLADWLRGSTEPPLGLEVSAVELDRLATLANVAEDADRFRRGARTLRAWAANWTRPADLPAWLTTESQYVGLWKSHARLAQLLDRWRSQRFNGDEAAFSALMVWREREAHLQQWETALRKRLDGQRKDIYRKFAARLARRYQVVATEDTDYRALKLRKPAEDNADDAAVKEHMRHGAPGLMRQYLRGRAAVELRIKSKDISRIHIDCGGINSEDRRPSILIVCPHCKVEYDQDVNAARNVLARAEVVNETPGAAREAQPKETGDDTLNDGGKRGRWSKRKADRSRKQVESAAQQ

SEQ ID NO: 244 - protein, 631 aa, Unknown
  source: /note="Description of Unknown: terrestrial-soil-terrestrial soil sequence"
MPIRVFEYGLKAPICNGPLVEQQMRSAHTYRNLLTQMERERRQEVRTIMAAHPDMAPLEARLAEIVTQRDEVRKAITTSRGITRSRSESPELRALARELGKQIREIRAEIKANRQAVAAAVKTDLDRIEIASVRRIKEARAACGVYWGTYLLQEADADRARQEAFPPQFRPWRGEGRVSVQLQKGLSIEELHGDDTQLHIDPVPPAAHDIGTRRGDRRRARRTMLRMRVQSDGRQPVWAVWPMRYHRPLPPGSVIKVATVSRRRHDCRSWDWMLHITVEIPDAAMKPSPASGVVALNLGFCLRPGGTIRAGYIVGSDGVEQEILVPRSVIDAISKCDSIRSIRDKNMDAMKAQMGQWLATVRATHEKIVQEIAARPPPADVDSAWYRFCAYWSMNGPAWPAWFAEATATLHAWRSADRFRRLAFRWRDNRFVGDATGFRILEGYSDQRFHDERDAWRYRDEHLERYESGMRRRALLRRRESYRIAAARLSATYRTLLIDDTDLRDFQRSPAPESESIEITRIKRNRGLAAGSELRLTMVNAFNGLSGRVVKISPATKPCHACGVVNTWDRTEDREHTCTACHQRWDQDANACRNMLLAHERDQATDADAPSKKRLSRSERLRKNRDAPKAA

SEQ ID NO: 245 - protein, 564 aa, Unknown
  source: /note="Description of Unknown: terrestrial-soil-terrestrial soil sequence"
MQRKTTTAPTRVYSYGCSFRGVTKNADLVEEQYRRAHAYQQKLVELELQRRAAVRAVLATDAGVVKLAEVVAQHEKALTDDLVAAAAIKQATRSKKLPPELRDRLAQTKQDLRAARDAWKAARRLFATDPNTKAALDKTNTDHVVAVKAARAASGLAWGTYLILERAADQQRNEKMDPKHRGYTGEGRLAVQFQGGTTVAGVFGGEDTRMRIEPKPGGSRKRHICKLRIGSDGRAPIWAEIEVFIHRQLPADSRITWARLKRTRRGRDYLYDLQITLESQTFAGVLQDMAHRRVAVDLGWRVTDKGAGGLRVAYWRDSDGRHEELRLPAKLLSSLDYPDQLLGIETNWFERAKAKLLAWRADVVLPEEHRSYTGTLAHWQSPLTLASYVWWWREHRFAGDELIFATMDEWRVRRFWHYRDWRMFQRDKALAARKDFYCVFASKLVVDCKELVLEDFDLSAFATKDTGPSAFRYWRRTGAPSELRLCLIAAAKKVGAKITLVDPAMTTRRCQACGSEEPWDQKTETVHTCKTCGTTWDQDDNATINMLASGSMVSGTSESLDPAE

SEQ ID NO: 246 - protein, 586 aa, Unknown
  source: /note="Description of Unknown: terrestrial-soil-tropical forest soil sequence"
MPITRIYRYGLLEPFLGAELVAEQMSLAHRYQNSLIELERGRRERVRAIMLGAPSLEEAQAIVDRAVKDLLDARQKIKDVRKAAQRRAETEADRASVSEIVVRLREARRVLKETRAAVRADSAIALSIAGVNDEIAEEQKRRRAACGVYWGSYLLVEQAMDAARKAIVDPRFRRWDGSGRIAVQLQGGLSWADACAGDTRLRVDLAPRAVGKGKPRPTVSLRVGSNGRDPVWASWPIILHRPVPEDATIMWAAVHRTILGGKARWHLLLTLRLPDDFVVEKGGKGTVAVDLGWRQRENGLRVGYMRDDAGDAGEILLEPAIVDGFKKVDDLRSIRDKRIDVMRPRLAEWLRERELPDWLAAERATMHLWKSAARFSRLAEIWRGKRWDGDVEGFDLLWAWRAKDRHLWLWEANLRDKVLARRLDRYRVLGAELARKYHTLVLEDFDLRNLQRHAKPESETVEIGPVRGRQRIAAPSLLRQKLVDAFVARGGRVVEVPSANTTRSCHACGLVEAWDPVTNLMHACTGCGALWDQDDNACRNLLLRERLGADEASEAARPTETEPKTSKWGRLGRHKKRPLASGNANE

SEQ ID NO: 247 - protein, 644 aa, Unknown
  source: /note="Description of Unknown: terrestrial-soil-tropical forest soil sequence"
MLVGWFRYNEARPAGGDVATCNNATMKRSEFNGRVLVYRFRCPVAASNIPEAAETQFRLAHELRNELVAVERAHADAVAAIWADHPDVAATLQAQAVAEAAVAELVERAGKERIADRAKEPRAQTRAEIKAARATLAAARQDTKAARSAAYPLVRPAMADAQTRRRQAIGDAGRGAKTRGLFWHTHDAVLAGHDTAVKRVAALRAEGKPAELRSRRWDGEGRIRVTLMRHEWSHGCGAQPCGQPSPECPRRQPGDPLRTPALLAGGQGPWRNVCRLPAHMDPAICAEHPPRRHGERETILLRVGSEEREPIWWELPVFVHRPLPPGADVAFVEVRRERLAGQTRLSVCVTVRLPPVATLTEGAVAAIHPGWRSVTGGIRVMVIAASRPLGPIPERFAPVVRPLTGNHVEIIAPEEWVRVLGHADSVRSIRDQALDVIRRKIVDALAEDVPGVEVSAADVARWRSPGRFAALVRQWPNDHPLADVLWAWRRQDRHLWKGEAHERDQIAARRTDTWRHVAVWLCDQVAVIGHAPTPIAELSRVPVIEDGDDRQATLARAHRALAAPAELVSLIEIAAGQRGVRIVEIDGARLTATHHVCGEVTGDLARDSVMLWCSRCGIAFDQDANAATASLARTIGDLSSAKVQ

SEQ ID NO: 248 - protein, 619 aa, Unknown
  source: /note="Description of Unknown: terrestrial-soil-tropical forest soil sequence"
MKRSEFNGRVLVYRFRCPVAASNIPEAAETQFRLAHELRNELVAVERAHADAVAAIWADHPDVAATLQAQAVAEAAVAELVERAGKERIADRAKEPRAQTRAEIKAARATLAAARQDTKAARSAAYPLVRPAMADAQTRRRQAIGDAGRGAKTRGLFWHTHDAVLAGHDTAVKRVAALRAEGKPAELRSRRWDGEGRIRVTLMRHEWSHGCGAQPCGQPSPECPRRQPGDPLRTPALLAGGQGPWRNVCRLPAHMDPAICAEHPPRRHGERETILLRVGSEEREPIWWELPVFVHRPLPPGADVAFVEVRRERLAGQTRLSVCVTVRLPPVATLTEGAVAAIHPGWRSVTGGIRVMVIAASRPLGPIPERFAPVVRPLTGNHVEIIAPEEWVRVLGHADSVRSIRDQALDVIRRKIVDALAEDVPGVEVSAADVARWRSPGRFAALVRQWPNDHPLADVLWAWRRQDRHLWKGEAHERDQIAARRTDTWRHVAVWLCDQVAVIGHAPTPIAELSRVPVIEDGDDRQATLARAHRALAAPAELVSLIEIAAGQRGVRIVEIDGARLTATHHVCGEVTGDLARDSVMLWCSRCGIAFDQDANAATASLARTIGDLSSAKVQ

SEQ ID NO: 249 - protein, 651 aa, Unknown
  source: /note="Description of Unknown: terrestrial-soil-tropical forest soil sequence"
MDNAAYRVLVGWFRYNEARPAGGDVATCNNATMKRSEFNGRVLVYRFRCPVAASNIPEAAETQFRLAHELRNELVAVERAHADAVAAIWADHPDVAATLQAQAVAEAAVAELVERAGKERIADRAKEPRAQTRAEIKAARATLAAARQDTKAARSAAYPLVRPAMADAQTRRRQAIGDAGRGAKTRGLFWHTHDAVLAGHDTAVKRVAALRAEGKPAELRSRRWDGEGRIRVTLMRHEWSHGCGAQPCGQPSPECPRRQPGDPLRTPALLAGGQGPWRNVCRLPAHMDPAICAEHPPRRHGERETILLRVGSEEREPIWWELPVFVHRPLPPGADVAFVEVRRERLAGQTRLSVCVTVRLPPVATLTEGAVAAIHPGWRSVTGGIRVMVIAASRPLGPIPERFAPVVRPLTGNHVEIIAPEEWVRVLGHADSVRSIRDQALDVIRRKIVDALAEDVPGVEVSAADVARWRSPGRFAALVRQWPNDHPLADVLWAWRRQDRHLWKGEAHERDQIAARRTDTWRHVAVWLCDQVAVIGHAPTPIAELSRVPVIEDGDDRQATLARAHRALAAPAELVSLIEIAAGQRGVRIVEIDGARLTATHHVCGEVTGDLARDSVMLWCSRCGIAFDQDANAATASLARTIGDLSSAKVQ

SEQ ID NO: 250 - protein, 598 aa, Unknown
  source: /note="Description of Unknown: terrestrial-soil-tropical forest soil sequence"
MPIRVYQFGLLPPIDGEARVRVLMRQCHEYRNELVAIERGRRAALRALHDTQEVADAVALVKASKGKPLREAIGKLYKARRAAEKAASHCPGVAEASVPEDASDAERSRLRRVNLEARAAAGDAVARITLLDESIRRDARALSPLSPGAWANYQTIEAAATQVRAMPLYERDAVTPSDPRFVKGPRAGQAFPVSNPKSCWWLGDQQVSMHIQGRTVTTADVLAGKDAWVRLELEPARLHGGTNGGKQQYSQYGVLKLRVANDTRCAVWASWPIKLHRAIPNAAKWQWVRVSCRRLARREVWTVEITLNDPQKIQPRPDVSGAVAVELLWTPLDDGSMRVASWRDSFGATGELLMSSRMVGAIRKADGIRSVRDTLLNALRPALAEKIQHSADKLPTWLREVGNVLHLWKSQDRFYELALRWRKDKVDAARDAYELLQEWELRDAHLLDYEAGSRRNGIGWRNHYYSNWAAGLARRYKAVIVPDRDLSLEARFGDDSDRRTTVSPQKLRDMLLNAFGEDAVKAVWKGPHGVPEDSDDTWLEVVSEQWRNEENTGGACAAEKDNAVADVGGSAWAKRKARARERAAGKDGARKDVGNTAE

SEQ ID NO: 251 - protein, 619 aa, Unknown
  source: /note="Description of Unknown: terrestrial-soil-tropical forest soil sequence"
MFGRKRDTAGATIRAYEFGTRPVGDMALASQQLYRRHQLWNQFVEIERDTRAKYRALVATESTQRVAALHEQLEELRQQIRLHKKSAAYEHVLHGKLRSLVEAMQSALADRSPETVAIVKPRLYFADIVSYDGLRERAKQLRQALGVMRAEAKAESRAKAEQLKAEREQLERERTDRVKAAMAASNLYWCNSDDVRASYEVARKRAMREGTELHFHRFDGGGKLSVRYQQGLPVAAAFGTDTRLQIDPIDFSIWESADRAVRRRCWTKARLRIGSNDQRQPVWLTLDCWLDGRPGRHLPMEGTIRAAAVIRRRVGTGFTHRLVLTVEAPLERRDLAVERHGTVGLDVGWRLTADNGLRVAYWSDGTAQGALTLPANMVGLFEKVHDLQSIRGQHFNAAVERLQGYLEEHPGAMWLQEQCRYIAQWRSPGRLIVLLRDWQSDGTDGELLEHLQAWRKKEDHLYSWQANLLDQTAAHRRELYRIFAASLGRYARVAIEEFDLRKVLQKPRPEDGAETPDGHMRTIAAVSVLRSAIENYCRREGVEFVVVPSSGTTRRCHVCQSEQQFDQRSDLVHRCTTCGETWDQDYNAAENIRQFADRPAGDTILPSAKISPEAPEARV

SEQ ID NO: 252 - protein, 592 aa, Unknown
  source: /note="Description of Unknown: terrestrial-soil-tropical forest soil sequence"
MIVHTLYIKTVDSETRKAVLAQMRAGHNYRNELVAIERGRRWALRQAHETPEVAEAIALLKAATRSNRFERLKALTRARRQAEEAIEKPQVYLACEAARIALRDEAAGTPRKKAAQAVYDAAREALCQSDEFHYAVGERDNWIRKAAYNDAKCNWGIRAVVNQAFEALRKTGLYERDGVTAWEPRFRRWAPNRPTGTIGVQLQGGLDVKDALSGDDTQVKLLLNPPIYKGSRQQRVRQFGELWVRIGSDGRSPIWARFNVMAHRALPTDAKIKWVKVHLTRTGPFERWEAHLTLDASAPPRPITNDRAVAVELLWSPQDDGSITAAHWRDGDGAEGFFALPAIIPTSIRKPDGIQSVRELLLNKMRPDLVALIKHYGSDLPVWLKEATNTLHLWESPLRFYDLAQCWRDSGFMGAKGAYDRLHEWELRDDHLWRYEACARKTAIRRRRDFYSCLAKNLSAQYRYVILPDRDLSRERRFGEERDIQFTVAPQELRAALTRCFGDETIEAPWRGAHGVEEDEYGDIDWLLFALEYGRDEKEARAAREAAKSSGDVKLTGGKWARIKAKRKEKDDAERGTRKESGKDAEGLGGER

SEQ ID NO: 253 - protein, 570 aa, Unknown
  source: /note="Description of Unknown: terrestrial-soil-tropical forest soil sequence"
MKRQAENVRSMVYQYGTVPARVAPVEGEELALSQMRLAQRLWNVLVTIERARVAGYRSIMRDEVQEQIDALRERKDATWQEIKATRQKARAKVATPGLDAEMMRIKTALRLLVEHKQSTKQQRHDARREQLNALAERANQRIKRARQAAASMGLFWGTYNAVIQSADAGRKHAGELRYQGFRGEGTVTAQVMGGATPEQCVAGGHPFFQVAPATPGQKWRYARVRIGSTSERQPLWVAIPVVYHREIPAEARIKSVSATRRILAGKVRWSLNVTVTLPPAEPRPAGQMVAIDIGWRLLPDGVRVAYWQDGTGNHSEVRIADSDIAQFRKISDLRSICDRAREEFLPSLVEWLKPYELDEEWTHRARALAQWRSNDRIAALIRWWADHRLSGDAEIYQTAVEWRRQYLHLANWWRNQQEQMTLRVREQYRRFAAGIASQFATVIVEDFDLRQVTETTEKAVGTYRQMVSPSLFRAAVINACKREGVEIRIVSGAYSTGACHNCQHIEVWDQAASILHRCGACGALWDQDHNAAINLLASGGVVLWRINLVAAIGPLSQDRSQTGGKEAVES

SEQ ID NO: 254 - protein, 612 aa, Unknown
  source: /note="Description of Unknown: terrestrial-soil-tropical peatland sequence"
MTARVYEYGLLDPTYNAQLVDDQMRAGHRYRNVLVEIERDRRTEVRNLLARHPDVEPLEAELLAARNDLADRRGQIRLQRKSTRTRSEGASMREAAHAAKLRVAEIRQRVNDAKAAIKEDAVVQAAIATADARAAERVRQARASCATYWGTYILHEADVARARASGGEVHFARWTGEGRVSAQIQGGIPSTDLAADTQVQIAPGQSIKDRRVPPNAKILRLRVQSDAKGKAIWAEWPMILHRPLPEEGRIKVVTVHKRRRDCRRWQWTVTFTVELLDGWTRGKCGEGAIALNLGYCRSYDHLKGAIRAGYLIDDRGQEREVIVPTSIIDRINKSEAIRSQRDKDVDTMRALLVAWLRDHEAILPGWIVDRTILAKAPKDANSPEAPRIWHITAWKSAARFRALAFAWRAARFQGDDVGYDLIERWRYRDEHLQRYEAGLLRGALLHRRDLYRQLAAELSAKYRTIVLHDTDLSDLQRSPHPEEDRREIGGAKYNQRIAAGSILRGALDNAFKRAGGEVVIVDDHRITKACWKCSEAEDWNQLDREHICGACGTRWDQDANACHNMLARERAGAEGRRQAARAAKTADRKETRSERLRRGLATKRKTEAARAM

SEQ ID NO: 255 - protein, 565 aa, Unknown
  source: /note="Description of Unknown: terrestrial-soil-tropical peatland sequence"
MFGNKSLPSRIYSYGANPAIENQKLVEDQMFLAHRYRNAMVEAEIERRKKVDEKLLSLSPSLARIEEKLAAATEELEKLRESIKEDHKLYFTKTAKDPVKTKAIAAQKKLVKGLYTERKALRTKLFASSKWKKEQEAIEAEALAAHKELREKSDLYWGTYLLVEQSMQGSRSGAPPRFMRWDGDGHIALQIQNGMTVEEALSGADTRLAIIPGRVEVDGSRTKETGIKRKLGTALCKFRIGTDEKTHSPIFASIPFHMHRPLPEDAQIKWVHFIRRRVSTHCEWRLQFVLSQKKWVKEDQAQEGTVGIDLGWSLDQEGYLQVACFAGSDGESGRLFLPADWLGEMKRVEGIRSIRDQNFNDAKALLQAFLRTSKEKSWLKEEAKTLPQWRSPAKLAWVIQKWRKERIPGDQHIFQAMEAWRLRDKHLYEFEANLRDQLLRRRESIYRNFAADLRRSYKTARILKLALKEVHELPQAEEAPENPQLREHSRDACLSFLVRCLRESMARTVEIDPKNQARRHHGCGSLEDLGANEKLHTCSRCGEIYERHENTARNLLGMMPAGAGV

SEQ ID NO: 256 - protein, 705 aa, Unknown
  source: /note="Description of Unknown: terrestrial-soil-tropical peatland sequence"
MERLPTETSPLDVVEMEREIDEARTATGWPTATVVHRYGIASPHEGADIVHEQIRLARAYRRELVTIERARRAAARQAMTELAPEVGFAEATVVGADAACQWLAAEIRAARAATRKRAESRGMRDRLTRARASLRTHRAELFALRSRYATQCADCRKAKSESVPCPHATAEARRLLERVDAVNDQAAAAQRRARGECGVYWGSYLLVERAMQASRAMPLYADDGVSPNDPSVPHSLSDSLGCQIQSTRPLTVAGAAAGTDSRLRIQPPPWPEAWLHEARLDPSAQSHPSHRLPGQRPDGTPAPATRADGTPARWVRDRACRQGEVRMRVGANGEWAAWRLDEHRAMPPNAAVKWATVVRRQRGPHTEWSLCLTLEVPLPEALPQTGRTVAVDVGWRQIGDELRVAAWQDSDGQKGELRLTKADLHALNASAEVRSLRDGKMESIKQRLAQWSAVASPQDCPEWIREALRTVRLWRNPVRLVRLLRQWREAGEPTRVVPRVAFDHLVAWADDDRHRWAEQESRRVWGLRRRRERYRVFAAELAKRYDAVVLEQFDLRRVAARPQTGRELESENEVARSNRQRASVSELRDALRNACRSRGRVVVAVDATDSTRTCPSCGLVADRGQDERVVLRCECGHEWDQDRDGAALVLLRRYREHPGDAKTLVAARAGATLAEPPKKKNDRWARARRMSTQKKERAQGARDSG

SEQ ID NO: 257 - protein, 640 aa, Unknown
  source: /note="Description of Unknown: terrestrial-soil-tropical peatland sequence"
MENQGEESAAAVPSEEEAPLDARVYQFGLLPPRVNRDLVEDQMYLGHRYRCQLVEFERDRRDAVREILSSQSGVEEIEARIADLAARRDAARAEIASKRSRSRSRSDSAEERATVREIGRQLKALRAEAKEARSIVASDEHVGAWISAENDRAAQRQKDARVACGVYWGTYLLHESDAQRARTGKSYPKFPRWNGDGRVAVQLQGGLSPQKLDHGQDTRLQVVSSSHRTGRRLGRGSLLRMRVQSNGRDPVWAEWPMILHRPLPEGVRIKTATVSRRRRGSQVDWCATITVDEPPRPIRATATEEAVAINLGYARRPNGGIRVGYWVGSDGAGGEILCQGSAAYRPRSSEEQIRAAVTHVEESLKKADSIRSFRDRGMNEMRARLIAWIDDFVGGDPPDGVPWWIADARRHLHLWRSPNRFASLLRRWERGWWPDLDGGYAILLAWSRRDLHLERYETGMRTTARRDRREGYRLLAARLAARYRTLVVDDADFRNFQRSPEPESDYVEVDAQKWQQRVASPSELRFAFLSAFGVDRTAKEPCEDVTRRHAPCGHVVDVAGDSRELRCPHCSEVEKREVLFDQDANACDNLLRGWLRKAPEMRQARTKRPPSIRRQRMIAGAKKKREAKAAEERRREARGG

SEQ ID NO: 258 - protein, 666 aa, Unknown
  source: /note="Description of Unknown: terrestrial-soil-vadose zone soil sequence"
MATLVYRYGVRAHGSARQQDAVVSDPAMLEQLRLGHELRNALVGVQHRYEDGKRAVWSGFASVAAADHRVTTGETAVAELEKQARAEHSADRTAATRQGTAESLKAARAAVKQARADRKAAMAAVAEQAKPKIQALGDDRDAEIKDLYRRFCQDGVLLPRCGRCAGDLRSDGDCTDCGAAHEPRKLYWATYNAIREDHQTAVKLVEAKRKAGQPARLRFRRWTGDGTLTVQLQRMHGPACRCVTCAEKLTRRARKTDPQAPAVAADPAYPPTDPPRDPALLASGQGKWRNVLQLGTWIPPGEWSAMSRAERRRVGRSHIGWQLGGGRQLTLPVQLHRQMPADADVAMAQLTRVRVGGRHRMSVALTAKLPDPPQVQGLPPVALHLGWRQRPDGSLRVATWACPQPLDLPPAVADVVVSHGGRWGEVIMPARWLADAEVPPRLLGRRDKAMEPVLEALADWLEAHTEACTARMTPALVRRWRSQGRLAGLTNRWRGQPPTGSAEILTYLEAWRIQDKLLWERESHLRRRLAARRDDAWRRVASWLARHAGVLVVDDADIAELRRRDDPADTDPTMPASAAQAARARAALAAPGRLRHLATITATRDGLGVHTVASAGLTRLHRKCGHQAQPDPRYAASAVVTCPGCGNGYDQDYNAAMLMLDRQQQP

SEQ ID NO: 259 - protein, 670 aa, Unknown
  source: /note="Description of Unknown: terrestrial-soil-vadose zone soil sequence"
MENNITVMRYGARVPITGLESVDRQLRLSKKYRNALCEIERRRRDGIARVQHGTRAGASPLDADELLAPLILKIDELEASISEMRKQTKLTHAGGGNPAARASLRDQIAAVKADLAVLRWLRGWSKSRLRLSDDERAAIAMCDGEKMSAWMIHRVKPWWALGVAVHATMNGSAALRLRCEYMIIDETAKYERRQARAVAGLSPGTYLLIEAAADKWRQNPEQPRFMRYDGTGRVGVQVQGGCTVAELEGGQDTRMRLLPATEIDPPVAPTSSRQIARAIAYGVVHFCRAGNMAPRDTYRILQLRVETMGRAPVWASIPIVYHRPLPADGVIVAAWLQRKKIGVRSVYDAQLVVRAAMTPQSHRPTTGTIAVDIGSRDIPSTGETRVAYSLDSSGAHAAMILPLFRLSSATSRGTGRRRIVPDDEKKIDDIKSIRSRHLDEIRDQITAYKVSVGAAASSPHPVPAIEWLRAATDRITSWRSPARIVWLRRQWQHHTGDEKIFSSIEAYIRQDRHLLDWQSREMRRRLGRRRELYRTAAMRLARTYDTIILAARDYRREEWVPEDAPSTRAHESRSIMRGAAPGEFREIIRRSAKKYGTTLIEMPLEGDTAWALDYRVCQRMLASTEVVDVQAAPLASASRSNHYGTDESFHRRRLGTDERIDPLARIDVSG

SEQ ID NO: 260 - protein, 479 aa, Unknown
  source: /note="Description of Unknown: terrestrial-soil-vadose zone soil sequence"
MIVYRYGALKPTEGFDLLLTQLRLACRYRNALVELLNWRIIAEQSGVERSAAKLVHAEMSCWLRSRCGLGWGTYQAIEADVRRAAKSPYRAPRKVSGRARWFAQVRQIKIQRPPDADGNQDAQVREIGLDPTKFRARFRRFDGTGRLGANIQACSGATTDDVLSGRGSLRLSAPEGRVTARLYLGLGIHVTLPVIAHRPLPPGVQVVRALICVERVGDRYVYSVHVTMRHERPERQYGSGRAAINFGWRSLGDRGVRIAYVATDEGSTDELILPRRLIDKLRHSESLRGLADDAAVAYLGDARGRTRARREALRDPSATHRELGRVPIEGEPISAEHWARRDRHLYQWERDEYAKVLRQRREIYRLWVRSLAAKYGSVVMEDYDLPTLISRDQPTEIPEARHVRFLVAPGSLRAEVQSVFGERATLATIKRRTMVCSVCGCELTGDRVRDVVLYCEQCDAQRDQDANNAANQLIDTAAE

SEQ ID NO: 261 - protein, 545 aa, Unknown
  source: /note="Description of Unknown: terrestrial-soil-vadose zone soil sequence"
MSTIVYRFGVHGAPLDNLELVKQQMRAAHNYANDLVAIERGRRTALHAIDDVPDVRNTIETVRQSTKSTRKAAITALRLARKAARAAAEEELARVQALDESIRRDARAITVCYWGSYLTIEMSAQQQRSQPLYEDDAITPNLPRFRGWREEGQIGIQIQKGLPTSAVRACTDTRARLDRSDRKKQGSKGRSVEYADLWIRIGSDGRAPIWTRVRVIMHRQIPDAAQWKWVRLSYRREGRTFAWSVEISVDVDRPKRTLDTTLRGAIAIEPQWSENADGSIVCATYRTEDGSSGEIELSPRIVGALRKADSIRAVRDMILNEARKDIHRALVEAGPALPVWLKDARNTMHLWKSQERFYRLANHWRRERCDAAREAYDRLQEWELRDDHLWRYEAGSRGQAIRSRNDFYHVIASQFARKHRFVIVPKRDYSREARFGAESDLRFIVSPSSLVSALDCSFDHGESAYVCPWVRPDGDGDSAEWPAIAIERFCAGDSAMIARKIRKENDSEEKQESAWARRKRLKREKEMRLATARITDGNGTKSLGQ

SEQ ID NO: 262 - protein, 632 aa, Unknown
  source: /note="Description of Unknown: wastewater-nutrient removal-wastewater effluent sequence"
MSTLVYRFGLLPPHENDALVRSQMRLAHRYRNDLVQIERARRAAVRDVARAAPEVARLELEAARTDAACAKVGGQIKAARAAGRTRKDSVELIEQLKALRIEHKEVVLALREARKTARVAAEPVLAEIEERVAAMRRGARAICGVYWGTYLMIEDADQAMRKMPLYDKDAEPSDPRFVPWTGDGSVGVQIQGGMTGEDTADDTRLRIESAAPPPGADPNSKRSLRRRYCVLAMRVGSEGRDPVWARWRMVMERPLPADARIKRAAVKLRRVGPREEWSVTITLETAERDRRVSDQVGMVGIDLGWRLMPDGLRVAAWHGSDGASGFLTLPDTRPTFHTTPGGRTRSSALGVVDAARKVEDLSSKRDKAFNEARSAIARIEGAPPWFELATKTISQWKSQGRLAALVRRWRDARWDGDAEAYEEAEKWRYHDHHLWAWETSQQAKALRARREVFRLFAADMAKRYARLAIEGLDLRAFARKTDDDTNETARRNRVVVAPSKLREALLLAFGSAINHWAETPKGDRVVVVEAAGTTMVHHECGSVERWDQATHVSHLCSSCGEIFDQDANAAKNILAAGERLGGPVLSGAARNDENVSNLSQVREGRWAKAKRMKAEKDARLEAARKAAPSAAE

SEQ ID NO: 263 - DNA, 37 bp, Artificial Sequence
  source: /note="Description of Artificial Sequence: Synthetic oligonucleotide"
gttgcaatgcctagctcagaggtttaaagactgagac

SEQ ID NO: 264 - DNA, 36 bp, Artificial Sequence
  source: /note="Description of Artificial Sequence: Synthetic oligonucleotide"
gtgtcaacgccagcgcggaggcgtcaaatccgcgac

SEQ ID NO: 265 - DNA, 25 bp, Artificial Sequence
  source: /note="Description of Artificial Sequence: Synthetic oligonucleotide"
gtagcaatgcctagctcaggggctt

SEQ ID NO: 266 - DNA, 36 bp, Artificial Sequence
  source: /note="Description of Artificial Sequence: Synthetic oligonucleotide"
gttacaaaccctgctcattgggttggttaatgagac

SEQ ID NO: 267 - DNA, 36 bp, Artificial Sequence
  source: /note="Description of Artificial Sequence: Synthetic oligonucleotide"
gtgagaatgaccagcgcaccggtcgaaaggtgcgac

SEQ ID NO: 268 - DNA, 36 bp, Artificial Sequence
  source: /note="Description of Artificial Sequence: Synthetic oligonucleotide"
gtgtcatagcccagcttggcgggcgaaggccaagac

SEQ ID NO: 269 - DNA, 36 bp, Artificial Sequence
  source: /note="Description of Artificial Sequence: Synthetic oligonucleotide"
gttgacatgcgtgctccgccgctttgtagtggagac

SEQ ID NO: 270 - DNA, 36 bp, Artificial Sequence
  source: /note="Description of Artificial Sequence: Synthetic oligonucleotide"
ttgataatgcccgctctgcggcctcgtagtagagac

SEQ ID NO: 271 - DNA, 32 bp, Artificial Sequence
  source: /note="Description of Artificial Sequence: Synthetic oligonucleotide"
caacgcctacagtgggcttcgtacattgtgac

SEQ ID NO: 272 - DNA, 28 bp, Artificial Sequence
  source: /note="Description of Artificial Sequence: Synthetic oligonucleotide"
cagcggcccacgcacgcgagggacggtc

SEQ ID NO: 273 - DNA, 37 bp, Artificial Sequence
  source: /note="Description of Artificial Sequence: Synthetic oligonucleotide"
caagcaagccttgccgaagaggctcgatcttcggacg

SEQ ID NO: 274 - DNA, 36 bp, Artificial Sequence
  source: /note="Description of Artificial Sequence: Synthetic oligonucleotide"
atgataagagtttctcgatactctataaatcgagac

SEQ ID NO: 275 - DNA, 36 bp, Artificial Sequence
  source: /note="Description of Artificial Sequence: Synthetic oligonucleotide"
caagcaagccttgccgaagaggctcgatcttcggac

SEQ ID NO: 276 - DNA, 37 bp, Artificial Sequence
  source: /note="Description of Artificial Sequence: Synthetic oligonucleotide"
ggttgaagcgcccgcgcaagggctttgtacttgcgac

SEQ ID NO: 277 - DNA, 36 bp, Artificial Sequence
  source: /note="Description of Artificial Sequence: Synthetic oligonucleotide"
gtcgcaatgccagccgaacggcttggaagttcggac

SEQ ID NO: 278 - DNA, 36 bp, Artificial Sequence
  source: /note="Description of Artificial Sequence: Synthetic oligonucleotide"
gtggctacggcatcgcggcgcctcggagatcgcgac

SEQ ID NO: 279 - DNA, 36 bp, Artificial Sequence
  source: /note="Description of Artificial Sequence: Synthetic oligonucleotide"
gtcgcagaggaagctcgacggatcgagcgtcgagag

SEQ ID NO: 280 - DNA, 36 bp, Artificial Sequence
  source: /note="Description of Artificial Sequence: Synthetic oligonucleotide"
gtcgcgatcgaagctccatcggctggcgatggagac

SEQ ID NO: 281 - DNA, 36 bp, Artificial Sequence
  source: /note="Description of Artificial Sequence: Synthetic oligonucleotide"
ccagaaagggcagcgcatcgcccaggagaatgcgac

SEQ ID NO: 282 - DNA, 37 bp, Artificial Sequence
  source: /note="Description of Artificial Sequence: Synthetic oligonucleotide"
gtagcaacgccagctcggttggttctgagccgagaca

SEQ ID NO: 283 - DNA, 36 bp, Artificial Sequence
  source: /note="Description of Artificial Sequence: Synthetic oligonucleotide"
gtggaaacgtcaatgtccggcggacgacgctggaac

SEQ ID NO: 284 - DNA, 51 bp, Artificial Sequence
  source: /note="Description of Artificial Sequence: Synthetic oligonucleotide"
cgctgcagggcctcaaacgactagacgaggcactggcaagctacgacaagg

SEQ ID NO: 285 - DNA, 24 bp, Artificial Sequence
  source: /note="Description of Artificial Sequence: Synthetic oligonucleotide"
ccaacaacggctgctgagcgcctt

SEQ ID NO: 286 - DNA, 28 bp, Artificial Sequence
  source: /note="Description of Artificial Sequence: Synthetic oligonucleotide"
ggctgctgagcgccttacaagctcagac

SEQ ID NO: 287 - DNA, 36 bp, Artificial Sequence
  source: /note="Description of Artificial Sequence: Synthetic oligonucleotide"
gtaacaacccctagcgcaagagggaaagcttgcgac

SEQ ID NO: 288 - DNA, 36 bp, Artificial Sequence
  source: /note="Description of Artificial Sequence: Synthetic oligonucleotide"
ccaacagcggctgctgaacgccttacaagttcagac

SEQ ID NO: 289 - DNA, 36 bp, Artificial Sequence
  source: /note="Description of Artificial Sequence: Synthetic oligonucleotide"
ctcacagtgcctgcgcagcggcttcgtagctgcgac

SEQ ID NO: 290 - DNA, 36 bp, Artificial Sequence
  source: /note="Description of Artificial Sequence: Synthetic oligonucleotide"
ccaacaacggctgctgaacgccttacaagttcagac

SEQ ID NO: 291 - DNA, 36 bp, Artificial Sequence
  source: /note="Description of Artificial Sequence: Synthetic oligonucleotide"
gttgcaatgcctgctcataggcttggtttatgagac

SEQ ID NO: 292 - DNA, 37 bp, Artificial Sequence
  source: /note="Description of Artificial Sequence: Synthetic oligonucleotide"
gtagcaataccctagctcgaggggggtttgtcgagac

SEQ ID NO: 293 - DNA, 37 bp, Artificial Sequence
  source: /note="Description of Artificial Sequence: Synthetic oligonucleotide"
gtttcagtatcctgctcagaggagtcgtttctgagac

SEQ ID NO: 294 - DNA, 39 bp, Artificial Sequence
  source: /note="Description of Artificial Sequence: Synthetic oligonucleotide"
gcgacgacaacggcagctcatcgccacgaaagatgagac

SEQ ID NO: 295 - DNA, 23 bp, Artificial Sequence
  source: /note="Description of Artificial Sequence: Synthetic oligonucleotide"
gtgcagggctgtcgaacctgcga

SEQ ID NO: 296 - DNA, 19 bp, Artificial Sequence
  source: /note="Description of Artificial Sequence: Synthetic oligonucleotide"
gctgggatgtttagtgatc

SEQ ID NO: 297 - DNA, 25 bp, Artificial Sequence
  source: /note="Description of Artificial Sequence: Synthetic oligonucleotide"
gctgggaggtttagtgatcccagac

SEQ ID NO: 298 - DNA, 37 bp, Artificial Sequence
  source: /note="Description of Artificial Sequence: Synthetic oligonucleotide"
gtcacaatgcctgcgcagaggctttgtttctgcgacg

SEQ ID NO: 299 - DNA, 36 bp, Artificial Sequence
  source: /note="Description of Artificial Sequence: Synthetic oligonucleotide"
gtatcaatgcctgctcaagggctttgtgcttgagac

SEQ ID NO: 300 - DNA, 36 bp, Artificial Sequence
  source: /note="Description of Artificial Sequence: Synthetic oligonucleotide"
ctcgcaatgccagcccagaggcggatgttctgggac

SEQ ID NO: 301 - DNA, 36 bp, Artificial Sequence
  source: /note="Description of Artificial Sequence: Synthetic oligonucleotide"
ctttcaagacgagcggaagcgtctgcttcttccgac

SEQ ID NO: 302 - DNA, 36 bp, Artificial Sequence
  source: /note="Description of Artificial Sequence: Synthetic oligonucleotide"
atcgaagagcctgctcaggggctttgttcttgagac

SEQ ID NO: 303 - DNA, 34 bp, Artificial Sequence
  source: /note="Description of Artificial Sequence: Synthetic oligonucleotide"
ctttcaagacgagcggaagcgtctgcttcttccg

SEQ ID NO: 304 - DNA, 24 bp, Artificial Sequence
  source: /note="Description of Artificial Sequence: Synthetic oligonucleotide"
taagtgtcagtgcctgcgcaccgg

SEQ ID NO: 305 - DNA, 37 bp, Artificial Sequence
  source: /note="Description of Artificial Sequence: Synthetic oligonucleotide"
caaacaatgcccgcgcagtgggcttcgtcactgcgac

SEQ ID NO: 306 - DNA, 36 bp, Artificial Sequence
  source: /note="Description of Artificial Sequence: Synthetic oligonucleotide"
gtagtaacgcccgcgaacaggcttcgtttgttcgac

SEQ ID NO: 307 - DNA, 37 bp, Artificial Sequence
  source: /note="Description of Artificial Sequence: Synthetic oligonucleotide"
cgttgcaagggctgcgcgacaccctggaagtcgcgac

SEQ ID NO: 308 - DNA, 37 bp, Artificial Sequence
  source: /note="Description of Artificial Sequence: Synthetic oligonucleotide"
gtcgcaatggggcgctcaccccccttgtaagtgagac

SEQ ID NO: 309 - DNA, 36 bp, Artificial Sequence
  source: /note="Description of Artificial Sequence: Synthetic oligonucleotide"
gtggcaaaggcatcgaatcgcctgagaagattcgac

SEQ ID NO: 310 - DNA, 31 bp, Artificial Sequence
  source: /note="Description of Artificial Sequence: Synthetic oligonucleotide"
aacgcctgcgaacaggcttcgtttgttcgac

SEQ ID NO: 311 - DNA, 37 bp, Artificial Sequence
  source: /note="Description of Artificial Sequence: Synthetic oligonucleotide"
gtcgcaatggggcgctcaccccctttgtaagtgagac

SEQ ID NO: 312 - DNA, 36 bp, Artificial Sequence
  source: /note="Description of Artificial Sequence: Synthetic oligonucleotide"
gttgcaagggctgcgcgacaccctggaagtcgcgac

SEQ ID NO: 313 - DNA, 39 bp, Artificial Sequence
  source: /note="Description of Artificial Sequence: Synthetic oligonucleotide"
gggtggcagtgcctgctcagaggcttagtatctgtgaca

SEQ ID NO: 314 - DNA, 38 bp, Artificial Sequence
  source: /note="Description of Artificial Sequence: Synthetic oligonucleotide"
tgtggcagtgcctgctcagaggcttagtatctgtgaca

SEQ ID NO: 315 - DNA, 36 bp, Artificial Sequence
  source: /note="Description of Artificial Sequence: Synthetic oligonucleotide"
gttgcaagggttgcgcgacaccctggaagtcgcgac

SEQ ID NO: 316 - DNA, 36 bp, Artificial Sequence
  source: /note="Description of Artificial Sequence: Synthetic oligonucleotide"
gtgcaaatgcccgcacagaggcttagtgtctgtgac

SEQ ID NO: 317 - DNA, 36 bp, Artificial Sequence
  source: /note="Description of Artificial Sequence: Synthetic oligonucleotide"
gtcacaacgcccgcgcaggggcttggtatctgcgac

SEQ ID NO: 318 - DNA, 36 bp, Artificial Sequence
  source: /note="Description of Artificial Sequence: Synthetic oligonucleotide"
ctttcaaagcttgctcgttagctttatgaacgagac

SEQ ID NO: 319 - DNA, 29 bp, Artificial Sequence
  source: /note="Description of Artificial Sequence: Synthetic oligonucleotide"
gtttgaaagcagctatagagggcagaaac

SEQ ID NO: 320 - DNA, 33 bp, Artificial Sequence
  source: /note="Description of Artificial Sequence: Synthetic oligonucleotide"
gcaagggctgctcagggccctggaatctgagac

SEQ ID NO: 321 - DNA, 36 bp, Artificial Sequence
  source: /note="Description of Artificial Sequence: Synthetic oligonucleotide"
atttaatgaccctgcgtgttggggtgtgaacacgac

SEQ ID NO: 322 - DNA, 36 bp, Artificial Sequence
  source: /note="Description of Artificial Sequence: Synthetic oligonucleotide"
cttacaatacctgcgagacggtttagaagtctcgac

SEQ ID NO: 323 - DNA, 36 bp, Artificial Sequence
  source: /note="Description of Artificial Sequence: Synthetic oligonucleotide"
ccttcaatccctgcgagacgggttagaagtctcgac

SEQ ID NO: 324 - DNA, 36 bp, Artificial Sequence
  source: /note="Description of Artificial Sequence: Synthetic oligonucleotide"
gtaacaacaccagtccaaaggtttatgatttggaac

SEQ ID NO: 325 - DNA, 36 bp, Artificial Sequence
  source: /note="Description of Artificial Sequence: Synthetic oligonucleotide"
ctcgcggtcccatcggaacgggttgtggttccgaca

SEQ ID NO: 326 - DNA, 27 bp, Artificial Sequence
  source: /note="Description of Artificial Sequence: Synthetic oligonucleotide"
gtctcaacgcctactcaggggctttgt

SEQ ID NO: 327 - DNA, 36 bp, Artificial Sequence
  source: /note="Description of Artificial Sequence: Synthetic oligonucleotide"
cttgcaacggcagcgtaccgccttcaagtgtgcgac

SEQ ID NO: 328 - DNA, 37 bp, Artificial Sequence
  source: /note="Description of Artificial Sequence: Synthetic oligonucleotide"
ccttgcaacggcagcgtaccgccttcaagtgtgcgac

SEQ ID NO: 329 - DNA, 36 bp, Artificial Sequence
  source: /note="Description of Artificial Sequence: Synthetic oligonucleotide"
ccgggaacagccgcgcaggggcttggtgcctgcgac

SEQ ID NO: 330 - DNA, 39 bp, Artificial Sequence
  source: /note="Description of Artificial Sequence: Synthetic oligonucleotide"
cgtcgcaacgcctgcggagaggccttgtttctccgacgg

SEQ ID NO: 331 - DNA, 36 bp, Artificial Sequence
  source: /note="Description of Artificial Sequence: Synthetic oligonucleotide"
gtttcagacccatcgcaaggggttatagcttgcgac

SEQ ID NO: 332 - DNA, 36 bp, Artificial Sequence
  source: /note="Description of Artificial Sequence: Synthetic oligonucleotide"
gtcgcaacgcctgcggagaggccttgtttctccgac

SEQ ID NO: 333 - DNA, 36 bp, Artificial Sequence
  source: /note="Description of Artificial Sequence: Synthetic oligonucleotide"
gttgcaaagccatctccagggtttggtgctggagac

SEQ ID NO: 334 - DNA, 36 bp, Artificial Sequence
  source: /note="Description of Artificial Sequence: Synthetic oligonucleotide"
gttggaatgcctgtggaaaggctttgtatttccaac

SEQ ID NO: 335 - DNA, 34 bp, Artificial Sequence
  source: /note="Description of Artificial Sequence: Synthetic oligonucleotide"
agcaatgcgagcgcagacgcttcgtatctgcgac

SEQ ID NO: 336 - DNA, 36 bp, Artificial Sequence
  source: /note="Description of Artificial Sequence: Synthetic oligonucleotide"
gtcacaacgcctgcgcaagggctttgttattgcgac

SEQ ID NO: 337 - DNA, 37 bp, Artificial Sequence
  source: /note="Description of Artificial Sequence: Synthetic oligonucleotide"
cttccaatacctgcgagacggtttagaagtctcgacg

SEQ ID NO: 338 - DNA, 36 bp, Artificial Sequence
  source: /note="Description of Artificial Sequence: Synthetic oligonucleotide"
ggagcaatgcctgcacgagggctttgtgctcgtgac

SEQ ID NO: 339 - DNA, 36 bp, Artificial Sequence
  source: /note="Description of Artificial Sequence: Synthetic oligonucleotide"
gtcgcaacgcctgcgcggaggctttgtttccgcgac

SEQ ID NO: 340 - DNA, 36 bp, Artificial Sequence
  source: /note="Description of Artificial Sequence: Synthetic oligonucleotide"
atggaaatgccattacaaaggtttaggatttgtaac

SEQ ID NO: 341 - DNA, 29 bp, Artificial Sequence
  source: /note="Description of Artificial Sequence: Synthetic oligonucleotide"
tgtcgcaaagccatctccaaggcttggtg

SEQ ID NO: 342 - DNA, 36 bp, Artificial Sequence
  source: /note="Description of Artificial Sequence: Synthetic oligonucleotide"
ctcgcaatcgaagctccgcccgttgtaggcggagac

SEQ ID NO: 343 - DNA, 34 bp, Artificial Sequence
  source: /note="Description of Artificial Sequence: Synthetic oligonucleotide"
tggaagagccatcgcaatggcttcggattgcgac

SEQ ID NO: 344 - DNA, 36 bp, Artificial Sequence
  source: /note="Description of Artificial Sequence: Synthetic oligonucleotide"
cacgaaaaggcagctcgatgccttacaaatcgagac

SEQ ID NO: 345 - DNA, 34 bp, Artificial Sequence
  source: /note="Description of Artificial Sequence: Synthetic oligonucleotide"
agaaatggttgtgaaatgcctttaaaatttcaac

SEQ ID NO: 346 - DNA, 31 bp, Artificial Sequence
  source: /note="Description of Artificial Sequence: Synthetic oligonucleotide"
acagaaatggtagtggaatgcctttaaaatt

SEQ ID NO: 347 - DNA, 36 bp, Artificial Sequence
  source: /note="Description of Artificial Sequence: Synthetic oligonucleotide"
gccacagcacctgctcgaacggttcgagttcgagac

SEQ ID NO: 348 - DNA, 36 bp, Artificial Sequence
  source: /note="Description of Artificial Sequence: Synthetic oligonucleotide"
ctgaaaacgccagcgcgaaggcttcatattcgcgac

SEQ ID NO: 349 - DNA, 37 bp, Artificial Sequence
  source: /note="Description of Artificial Sequence: Synthetic oligonucleotide"
gtgcaagagcctgcgccgaggcgtcgtatcggcgaca

SEQ ID NO: 350 - DNA, 36 bp, Artificial Sequence
  source: /note="Description of Artificial Sequence: Synthetic oligonucleotide"
gtggaaagggtatctctggaccttacaatcagagac

SEQ ID NO: 351 - DNA, 22 bp, Artificial Sequence
  source: /note="Description of Artificial Sequence: Synthetic oligonucleotide"
gccgcaacgcctgtggaagggc

SEQ ID NO: 352 - DNA, 36 bp, Artificial Sequence
  source: /note="Description of Artificial Sequence: Synthetic oligonucleotide"
ggtgcagcggttgctcagcaccgtagaagctgagag

SEQ ID NO: 353 - DNA, 21 bp, Artificial Sequence
  source: /note="Description of Artificial Sequence: Synthetic oligonucleotide"
cccgtgcccgtctccgtctcc

SEQ ID NO: 354 - DNA, 22 bp, Artificial Sequence
  source: /note="Description of Artificial Sequence: Synthetic oligonucleotide"
gatcgcgacggcgacggtatcc

SEQ ID NO: 355 - DNA, 36 bp, Artificial Sequence
  source: /note="Description of Artificial Sequence: Synthetic oligonucleotide"
ggcgtccgccagcgtcggggcaaccacaccgacgac

SEQ ID NO: 356 - DNA, 37 bp, Artificial Sequence
  source: /note="Description of Artificial Sequence: Synthetic oligonucleotide"
gttgcagtgcccagctcaggggcttgataactgagac

SEQ ID NO: 357 - DNA, 26 bp, Artificial Sequence
  source: /note="Description of Artificial Sequence: Synthetic oligonucleotide"
tagtgagtttagcacatttctaaaac

SEQ ID NO: 358 - DNA, 36 bp, Artificial Sequence
  source: /note="Description of Artificial Sequence: Synthetic oligonucleotide"
gtttaagtagtagtgagtttagcacatctctaaaac

SEQ ID NO: 359 - DNA, 35 bp, Artificial Sequence
  source: /note="Description of Artificial Sequence: Synthetic oligonucleotide"
ttaagtagtagtgagtttagcatatttctaaaacg

SEQ ID NO: 360 - DNA, 33 bp, Artificial Sequence
  source: /note="Description of Artificial Sequence: Synthetic oligonucleotide"
taagtaatagtgagtttagcacatctctaaaac

SEQ ID NO: 361 - DNA, 34 bp, Artificial Sequence
  source: /note="Description of Artificial Sequence: Synthetic oligonucleotide"
ttaagtaatagtgagtttagcacatctctaaaac

SEQ ID NO: 362 - DNA, 36 bp, Artificial Sequence
  source: /note="Description of Artificial Sequence: Synthetic oligonucleotide"
ggttaagtagtagtgagtttagcacatctctaaaac

SEQ ID NO: 363 - DNA, 32 bp, Artificial Sequence
  source: /note="Description of Artificial Sequence: Synthetic oligonucleotide"
gtttaagtagtagtgagtttagcacatttcta

SEQ ID NO: 364 - DNA, 36 bp, Artificial Sequence
  source: /note="Description of Artificial Sequence: Synthetic oligonucleotide"
gtagcaatggcagcgcatcgccttttaagatgcgac

SEQ ID NO: 365 - DNA, 26 bp, Artificial Sequence
  source: /note="Description of Artificial Sequence: Synthetic oligonucleotide"
taatgagtttagcatatctctaaaac

SEQ ID NO: 366 - DNA, 23 bp, Artificial Sequence
  source: /note="Description of Artificial Sequence: Synthetic oligonucleotide"
tgagtttagcatatctctaaaac

SEQ ID NO: 367 - DNA, 36 bp, Artificial Sequence
  source: /note="Description of Artificial Sequence: Synthetic oligonucleotide"
ggttaagtagtagtgagtttagcatatctctaaaac

SEQ ID NO: 368 - DNA, 36 bp, Artificial Sequence
  source: /note="Description of Artificial Sequence: Synthetic oligonucleotide"
ggttaaatagtagtgagtttagcacatctctaaaac

SEQ ID NO: 369 - DNA, 36 bp, Artificial Sequence
  source: /note="Description of Artificial Sequence: Synthetic oligonucleotide"
gtaacagaggctgctcaatgcctttgaaattgagac

SEQ ID NO: 370 - DNA, 36 bp, Artificial Sequence
  source: /note="Description of Artificial Sequence: Synthetic oligonucleotide"
gtaacaatcccagtgcaacgggttagtagttgcaac

SEQ ID NO: 371 - DNA, 36 bp, Artificial Sequence
  source: /note="Description of Artificial Sequence: Synthetic oligonucleotide"
gtgtggaggcagctcggtgccgatggaaactgagac

SEQ ID NO: 372 - DNA, 36 bp, Artificial Sequence
  source: /note="Description of Artificial Sequence: Synthetic oligonucleotide"
cttgcaatggctgcgcagggccttggacgctgcgac

SEQ ID NO: 373 - DNA, 18 bp, Artificial Sequence
  source: /note="Description of Artificial Sequence: Synthetic oligonucleotide"
tcgaattcggttgacgct

SEQ ID NO: 374 - DNA, 37 bp, Artificial Sequence
  source: /note="Description of Artificial Sequence: Synthetic oligonucleotide"
gttggcaatagaagctaacctctataagcgttagacc

SEQ ID NO: 375 - DNA, 36 bp, Artificial Sequence
  source: /note="Description of Artificial Sequence: Synthetic oligonucleotide"
gtggagaggccagcgcaggggctttgtgcctgcgac

SEQ ID NO: 376 - DNA, 29 bp, Artificial Sequence
  source: /note="Description of Artificial Sequence: Synthetic oligonucleotide"
gttgaaaaccccatcgattcggggtagtg

SEQ ID NO: 377 - DNA, 36 bp, Artificial Sequence
  source: /note="Description of Artificial Sequence: Synthetic oligonucleotide"
ctcgcaagcgttgctcgacacgctaggtgtcgagac

SEQ ID NO: 378 - DNA, 23 bp, Artificial Sequence
  source: /note="Description of Artificial Sequence: Synthetic oligonucleotide"
tcgtcctgcagcgtgatcccgcc

SEQ ID NO: 379 - DNA, 39 bp, Artificial Sequence
  source: /note="Description of Artificial Sequence: Synthetic oligonucleotide"
gccgtcgaaatgcctgctcgggggcttcgtacctgagac

SEQ ID NO: 380 - DNA, 20 bp, Artificial Sequence
  source: /note="Description of Artificial Sequence: Synthetic oligonucleotide"
aagagcatcccgggcgcgaa

SEQ ID NO: 381 - DNA, 36 bp, Artificial Sequence
  source: /note="Description of Artificial Sequence: Synthetic oligonucleotide"
gtaggaacccctagtgtcctgggtggagaggacaac

SEQ ID NO: 382 - DNA, 24 bp, Artificial Sequence
  source: /note="Description of Artificial Sequence: Synthetic oligonucleotide"
gcgcgggggcttggttcctgcgac

SEQ ID NO: 383 - DNA, 36 bp, Artificial Sequence
  source: /note="Description of Artificial Sequence: Synthetic oligonucleotide"
gaaacaaagcgtgctctgccgcttggaagcagagac

SEQ ID NO: 384 - DNA, 18 bp, Artificial Sequence
  source: /note="Description of Artificial Sequence: Synthetic oligonucleotide"
cgtgacgatggttgctcg

SEQ ID NO: 385 - DNA, 31 bp, Artificial Sequence
  source: /note="Description of Artificial Sequence: Synthetic oligonucleotide"
aatccctgctcaagagggtgtgtcttgagac

SEQ ID NO: 386 - DNA, 36 bp, Artificial Sequence
  source: /note="Description of Artificial Sequence: Synthetic oligonucleotide"
ctcgcaatcgttgctggacggacttctcgttcagac

SEQ ID NO: 387 - DNA, 36 bp, Artificial Sequence
  source: /note="Description of Artificial Sequence: Synthetic oligonucleotide"
gtcgaaatgcccgctcagcggcttagttgctgagac

SEQ ID NO: 388 - DNA, 36 bp, Artificial Sequence
  source: /note="Description of Artificial Sequence: Synthetic oligonucleotide"
gtcgagatcaggctccatgagatcgaccatggagac

SEQ ID NO: 389 - DNA, 38 bp, Artificial Sequence
  source: /note="Description of Artificial Sequence: Synthetic oligonucleotide"
ggtgacaaagccctgtgcagcgggctcaaagctgcgac

SEQ ID NO: 390 - DNA, 36 bp, Artificial Sequence
  source: /note="Description of Artificial Sequence: Synthetic oligonucleotide"
gtcgcaacgcctgcgtcggggcctcgtgccgacgac

SEQ ID NO: 391 - DNA, 33 bp, Artificial Sequence
  source: /note="Description of Artificial Sequence: Synthetic oligonucleotide"
gcaatggctgctcagcgcccttgaagctgagac

SEQ ID NO: 392 - DNA, 28 bp, Artificial Sequence
  source: /note="Description of Artificial Sequence: Synthetic oligonucleotide"
agcctgcgcggtggctgaggaccgcgac

SEQ ID NO: 393 - DNA, 36 bp, Artificial Sequence
  source: /note="Description of Artificial Sequence: Synthetic oligonucleotide"
gtgtggaggctgctcaaggccgatggaacttgagac

SEQ ID NO: 394 - DNA, 37 bp, Artificial Sequence
  source: /note="Description of Artificial Sequence: Synthetic oligonucleotide"
ggtggcacgagttgctcggcgctctacgagccgagac

SEQ ID NO: 395 - DNA, 31 bp, Artificial Sequence
  source: /note="Description of Artificial Sequence: Synthetic oligonucleotide"
aacatctgctcgatcgatccgagatcgagcc

SEQ ID NO: 396 - DNA, 34 bp, Artificial Sequence
  source: /note="Description of Artificial Sequence: Synthetic oligonucleotide"
tggaaaccctgcgcagggggttaaagcctgcgac

SEQ ID NO: 397 - DNA, 36 bp, Artificial Sequence
  source: /note="Description of Artificial Sequence: Synthetic oligonucleotide"
gtctcaatggctgcgacgagccgtgcaatcgtcgac

SEQ ID NO: 398 - DNA, 21 bp, Artificial Sequence
  source: /note="Description of Artificial Sequence: Synthetic oligonucleotide"
cgcaagcattcgtcacaatca

SEQ ID NO: 399 - DNA, 36 bp, Artificial Sequence
  source: /note="Description of Artificial Sequence: Synthetic oligonucleotide"
gttgtagaggtaacgaagcacctgaaagacttcgag

SEQ ID NO: 400 - DNA, 20 bp, Artificial Sequence
  source: /note="Description of Artificial Sequence: Synthetic oligonucleotide"
ggtagcgaaacaccttgaag

SEQ ID NO: 401 - DNA, 36 bp, Artificial Sequence
  source: /note="Description of Artificial Sequence: Synthetic oligonucleotide"
gtggaaaagagcagcgcggggctccaacgccgcgac

SEQ ID NO: 402 - DNA, 36 bp, Artificial Sequence
  source: /note="Description of Artificial Sequence: Synthetic oligonucleotide"
gctgcaaaggacgtggcgttccttgaacacgccaac

SEQ ID NO: 403 - DNA, 37 bp, Artificial Sequence
  source: /note="Description of Artificial Sequence: Synthetic oligonucleotide"
gttgcaatgccgactccgcggcttggttgcggagagg

SEQ ID NO: 404 - DNA, 36 bp, Artificial Sequence
  source: /note="Description of Artificial Sequence: Synthetic oligonucleotide"
gtcgcaggtgatgctctgaggctttggatcggagac

SEQ ID NO: 405 - DNA, 36 bp, Artificial Sequence
  source: /note="Description of Artificial Sequence: Synthetic oligonucleotide"
gtggaaagggcagcgcagagcccgtgatgctgcgac

SEQ ID NO: 406 - DNA, 33 bp, Artificial Sequence
  source: /note="Description of Artificial Sequence: Synthetic oligonucleotide"
cggcgtgccctcgtcctgcaccgtgatcccggc

SEQ ID NO: 407 - DNA, 36 bp, Artificial Sequence
  source: /note="Description of Artificial Sequence: Synthetic oligonucleotide"
gcgactgcgtttgctcggtgacgggttcaccgagac

SEQ ID NO: 408 - DNA, 36 bp, Artificial Sequence
  source: /note="Description of Artificial Sequence: Synthetic oligonucleotide"
gtaacaatgccagcccagaggcaaaggttctgggac

SEQ ID NO: 409 - DNA, 28 bp, Artificial Sequence
  source: /note="Description of Artificial Sequence: Synthetic oligonucleotide"
gtgcagcccctgggcacgtgggcgacgg

SEQ ID NO: 410 - DNA, 37 bp, Artificial Sequence
  source: /note="Description of Artificial Sequence: Synthetic oligonucleotide"
gatcacacggcgacctccgccgcctcgaagcggagac

SEQ ID NO: 411 - DNA, 36 bp, Artificial Sequence
  source: /note="Description of Artificial Sequence: Synthetic oligonucleotide"
ctcacaacggcagcgaggcgccttggagtcctcgac

SEQ ID NO: 412 - DNA, 36 bp, Artificial Sequence
  source: /note="Description of Artificial Sequence: Synthetic oligonucleotide"
gtagcaagaggtgctcatgcctctagaatatgagac

SEQ ID NO: 413 - DNA, 36 bp, Artificial Sequence
  source: /note="Description of Artificial Sequence: Synthetic oligonucleotide"
gtagcaaaggcagcttgacgccttaaagatcaagac

SEQ ID NO: 414 - DNA, 36 bp, Artificial Sequence
  source: /note="Description of Artificial Sequence: Synthetic oligonucleotide"
ctcgcaacgccagcgcaggggccatgacgctgcgac

SEQ ID NO: 415 - DNA, 36 bp, Artificial Sequence
  source: /note="Description of Artificial Sequence: Synthetic oligonucleotide"
gcatcaaaggcagtccgatgcctctcaaatcggaac

SEQ ID NO: 416 - DNA, 36 bp, Artificial Sequence
  source: /note="Description of Artificial Sequence: Synthetic oligonucleotide"
gttggaaaggctgctcgaacgccttcaagtcgagag

SEQ ID NO: 417 - DNA, 27 bp, Artificial Sequence
  source: /note="Description of Artificial Sequence: Synthetic oligonucleotide"
ccgtgcgcagccggataacgctgcgac

SEQ ID NO: 418 - DNA, 36 bp, Artificial Sequence
  source: /note="Description of Artificial Sequence: Synthetic oligonucleotide"
gtcgcgaagctagcgcagaagcttggtatctgcgag

SEQ ID NO: 419 - DNA, 19 bp, Artificial Sequence
  source: /note="Description of Artificial Sequence: Synthetic oligonucleotide"
gcatcaagtcttatctcgc

SEQ ID NO: 420 - DNA, 20 bp, Artificial Sequence
  source: /note="Description of Artificial Sequence: Synthetic oligonucleotide"
ggcagcgaaacgccttgaag

SEQ ID NO: 421 - DNA, 36 bp, Artificial Sequence
  source: /note="Description of Artificial Sequence: Synthetic oligonucleotide"
gtgtaatgcccggcagaaggctttggattctgcgac

SEQ ID NO: 422 - DNA, 37 bp, Artificial Sequence
  source: /note="Description of Artificial Sequence: Synthetic oligonucleotide"
gtagcaatgcctaccaagaggctttgtatcttgtgag

SEQ ID NO: 423 - DNA, 37 bp, Artificial Sequence
  source: /note="Description of Artificial Sequence: Synthetic oligonucleotide"
ggcgcaagccctgcgcgggagggcaagatcctgcgac

SEQ ID NO: 424 - DNA, 19 bp, Artificial Sequence
  source: /note="Description of Artificial Sequence: Synthetic oligonucleotide"
caagccacgctcgggtggc

SEQ ID NO: 425 - DNA, 23 bp, Artificial Sequence
  source: /note="Description of Artificial Sequence: Synthetic oligonucleotide"
ggagagggatcgtttcttcgacc

SEQ ID NO: 426 - DNA, 36 bp, Artificial Sequence
  source: /note="Description of Artificial Sequence: Synthetic oligonucleotide"
ccgacaacgcctgcgcaggggcgtggtttctgcgac

SEQ ID NO: 427 - DNA, 37 bp, Artificial Sequence
  source: /note="Description of Artificial Sequence: Synthetic oligonucleotide"
ggtgcaacgtgccttgcgagggcttgatactcgcgac

SEQ ID NO: 428 - DNA, 36 bp, Artificial Sequence
  source: /note="Description of Artificial Sequence: Synthetic oligonucleotide"
gtggtaatggcagcgcagcgcctttgagactgcgac

SEQ ID NO: 429 - DNA, 37 bp, Artificial Sequence
  source: /note="Description of Artificial Sequence: Synthetic oligonucleotide"
gttgcagtaccctgctcacgggggagacaagtgagag

SEQ ID NO: 430 - DNA, 36 bp, Artificial Sequence
  source: /note="Description of Artificial Sequence: Synthetic oligonucleotide"
ggtgaaatggcatcgggaggccacaaacgttccgac

SEQ ID NO: 431 - DNA, 27 bp, Artificial Sequence
  source: /note="Description of Artificial Sequence: Synthetic oligonucleotide"
gtgatagtgcctgctcagtggcttagt

SEQ ID NO: 432 - DNA, 36 bp, Artificial Sequence
  source: /note="Description of Artificial Sequence: Synthetic oligonucleotide"
gtgacaagagcagcgcggcgctctgcgagccgcgac

SEQ ID NO: 433 - DNA, 23 bp, Artificial Sequence
  source: /note="Description of Artificial Sequence: Synthetic oligonucleotide"
cgagtaggcttagtttgctcgac

SEQ ID NO: 434 - DNA, 36 bp, Artificial Sequence
  source: /note="Description of Artificial Sequence: Synthetic oligonucleotide"
ggcgaagcgtcagcgcagccgtctcgaggctgcgac

SEQ ID NO: 435 - DNA, 36 bp, Artificial Sequence
  source: /note="Description of Artificial Sequence: Synthetic oligonucleotide"
gtcgcgatggctgctcgacgccaggaagatcgagac

SEQ ID NO: 436 - DNA, 36 bp, Artificial Sequence
  source: /note="Description of Artificial Sequence: Synthetic oligonucleotide"
gtcgaaatgcccgcgcgggggcgtcgtacccgcgac

SEQ ID NO: 437 - DNA, 40 bp, Artificial Sequence
  source: /note="Description of Artificial Sequence: Synthetic oligonucleotide"
gcgtgtagtaagagcagcggtgtcgctctgagatgccgac

SEQ ID NO: 438 - DNA, 36 bp, Artificial Sequence
  source: /note="Description of Artificial Sequence: Synthetic oligonucleotide"
gcccaaaggcagctcggcgcctacagaagccgagac

SEQ ID NO: 439 - DNA, 37 bp, Artificial Sequence
  source: /note="Description of Artificial Sequence: Synthetic oligonucleotide"
ggtcgaaatgcctgcgcaggggcttcaacgctgcgac

SEQ ID NO: 440 - DNA, 36 bp, Artificial Sequence
  source: /note="Description of Artificial Sequence: Synthetic oligonucleotide"
atcgaagagcctgcgcagaggcttttgatctgcgat

SEQ ID NO: 441-1000 - skipped (560 entries)

SEQ ID NO: 1001 - DNA, 54 bp, Artificial Sequence
  source: /note="Description of Artificial Sequence: Synthetic oligonucleotide"
  modified_base (37)..(54): a, c, t, g, unknown or other
tttcatcggccatcgcggcggcctcgtagctgcgacnnnnnnnnnnnnnnnnnn

SEQ ID NO: 1002 - DNA, 53 bp, Artificial Sequence
  source: /note="Description of Artificial Sequence: Synthetic oligonucleotide"
  modified_base (36)..(53): a, c, t, g, unknown or other
ttcatcggccatcgcggcggcctcgtagctgcgacnnnnnnnnnnnnnnnnnn

SEQ ID NO: 1003 - DNA, 52 bp, Artificial Sequence
  source: /note="Description of Artificial Sequence: Synthetic oligonucleotide"
  modified_base (35)..(52): a, c, t, g, unknown or other
acaacagccattaccctggcttagtaagggtgacnnnnnnnnnnnnnnnnnn

SEQ ID NO: 1004 - DNA, 53 bp, Artificial Sequence
  source: /note="Description of Artificial Sequence: Synthetic oligonucleotide"
  modified_base (36)..(53): a, c, t, g, unknown or other
ttccaaggcgatcacagccgcctagtagttgtgacnnnnnnnnnnnnnnnnnn

SEQ ID NO: 1005 - protein, 2 aa, Artificial Sequence
  source: /note="Description of Artificial Sequence: Synthetic peptide"
GS

SEQ ID NO: 1006 - protein, 7 aa, Artificial Sequence
  source: /note="Description of Artificial Sequence: Synthetic peptide"
GSGGGGS

SEQ ID NO: 1007 - protein, 15 aa, Artificial Sequence
  source: /note="Description of Artificial Sequence: Synthetic peptide"
GGGGSGGGGSGGGGS

SEQ ID NO: 1008 - protein, 18 aa, Artificial Sequence
  source: /note="Description of Artificial Sequence: Synthetic peptide"
GGSGGSGGSGGSGGSGGS

SEQ ID NO: 1009 - protein, 32 aa, Artificial Sequence
  source: /note="Description of Artificial Sequence: Synthetic polypeptide"
SGGSSGGSSGSETPGTSESATPESSGGSSGGS

SEQ ID NO: 1010 - protein, 167 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 1011 - protein, 167 aa, Artificial Sequence; identical to SEQ ID NO: 1010
  source: /note="Description of Artificial Sequence: Synthetic polypeptide"

SEQ ID NO: 1012 - protein, 198 aa, Artificial Sequence [sequence omitted]

SEQ ID NO: 1013 - protein, 208 aa, Artificial Sequence
  source: /note="Description of Artificial Sequence: Synthetic polypeptide"
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 1014 - protein, 229 aa, Artificial Sequence [sequence omitted]

SEQ ID NO: 1015 - protein, 4 aa, Unknown
  source: /note="Description of Unknown: KDEL retention sequence"
KDEL

SEQ ID NO: 1016 - protein, 5 aa, Artificial Sequence
  source: /note="Description of Artificial Sequence: Synthetic peptide"
EAAAK

SEQ ID NO: 1017 - DNA, 36 bp, Artificial Sequence
  source: /note="Description of Artificial Sequence: Synthetic oligonucleotide"
gtcacaatgcctgcgcagaggctttgtttctgcgac

SEQ ID NO: 1018 - DNA, 37 bp, Artificial Sequence
  source: /note="Description of Artificial Sequence: Synthetic oligonucleotide"
cgtcgcaacgcctgcggagaggccttgtttctccgac

SEQ ID NO: 1019 - DNA, 36 bp, Artificial Sequence
  source: /note="Description of Artificial Sequence: Synthetic oligonucleotide"
ccgacaacgcctgcgcaggggcttggtttctgcgac

SEQ ID NO: 1020 - DNA, 38 bp, Artificial Sequence
  source: /note="Description of Artificial Sequence: Synthetic oligonucleotide"
gggtggcagtgcctgctcagaggcttagtatctgtgac

SEQ ID NO: 1021 - DNA, 37 bp, Artificial Sequence
  source: /note="Description of Artificial Sequence: Synthetic oligonucleotide"
tgtggcagtgcctgctcagaggcttagtatctgtgac

SEQ ID NO: 1022 - DNA, 36 bp, Artificial Sequence
  source: /note="Description of Artificial Sequence: Synthetic oligonucleotide"
gtgtcaacgccagcgcggaggcgtgaaatccgagac

SEQ ID NO: 1023 - RNA, 36 nt, Artificial Sequence
  source: /note="Description of Artificial Sequence: Synthetic oligonucleotide"
guguuaugcccaucucagcgggcugguugcugagac

SEQ ID NO: 1024 - RNA, 25 nt, Artificial Sequence
  source: /note="Description of Artificial Sequence: Synthetic oligonucleotide"
guuauaguggccauuguaggggcuu

SEQ ID NO: 1025 - RNA, 37 nt, Artificial Sequence
  source: /note="Description of Artificial Sequence: Synthetic oligonucleotide"
guuucaucggccaucgcggcggccucguagcugcgac

SEQ ID NO: 1026 - RNA, 36 nt, Artificial Sequence
  source: /note="Description of Artificial Sequence: Synthetic oligonucleotide"
gguuuaaggcgaucacggccgccuaguugccgcgac

SEQ ID NO: 1027 - RNA, 27 nt, Artificial Sequence
  source: /note="Description of Artificial Sequence: Synthetic oligonucleotide"
guuucaucagccauugcaggggcuuug

SEQ ID NO: 1028 - RNA, 37 nt, Artificial Sequence
  source: /note="Description of Artificial Sequence: Synthetic oligonucleotide"
ggugcucaagccaucgcagcggcaucguugcugcgac

SEQ ID NO: 1029 - RNA, 29 nt, Artificial Sequence
  source: /note="Description of Artificial Sequence: Synthetic oligonucleotide"
gagcgguuaacagggugucgauauagauu

SEQ ID NO: 1030 - RNA, 37 nt, Artificial Sequence
  source: /note="Description of Artificial Sequence: Synthetic oligonucleotide"
guaacaacagccauuacccuggcuuaguaagggugac

SEQ ID NO: 1031 - RNA, 34 nt, Artificial Sequence
  source: /note="Description of Artificial Sequence: Synthetic oligonucleotide"
aguagaacccugucgcuugggcgguaaagcgaac

SEQ ID NO: 1032 - RNA, 36 nt, Artificial Sequence
  source: /note="Description of Artificial Sequence: Synthetic oligonucleotide"
gauuaaggccccugugcauugggguguaaaugcaac

SEQ ID NO: 1033 - RNA, 36 nt, Artificial Sequence
  source: /note="Description of Artificial Sequence: Synthetic oligonucleotide"
gucuaaggccccugugcauugggguguaaaugcaac

SEQ ID NO: 1034 - RNA, 36 nt, Artificial Sequence
  source: /note="Description of Artificial Sequence: Synthetic oligonucleotide"
cuuuaaggacccuguacguugggguguaaacguaac

SEQ ID NO: 1035 - RNA, 26 nt, Artificial Sequence
  source: /note="Description of Artificial Sequence: Synthetic oligonucleotide"
gguaucaugacccuacgggugggggg

SEQ ID NO: 1036 - RNA, 29 nt, Artificial Sequence
  source: /note="Description of Artificial Sequence: Synthetic oligonucleotide"
agccaucgcaggggcuuggugcuugcgac

SEQ ID NO: 1037 - RNA, 36 nt, Artificial Sequence
  source: /note="Description of Artificial Sequence: Synthetic oligonucleotide"
auuccaaggcgaucacagccgccuaguaguugugac

SEQ ID NO: 1038 - RNA, 37 nt, Artificial Sequence
  source: /note="Description of Artificial Sequence: Synthetic oligonucleotide"
guuuuagaacccuguugagugggcauaaacucaaacu

SEQ ID NO: 1039 - RNA, 26 nt, Artificial Sequence
  source: /note="Description of Artificial Sequence: Synthetic oligonucleotide"
gguaucaugacccuacggaugggggg

SEQ ID NO: 1040 - RNA, 36 nt, Artificial Sequence
  source: /note="Description of Artificial Sequence: Synthetic oligonucleotide"
gauucauagcccugucgguugggcgguaaaccgaac

SEQ ID NO: 1041 - RNA, 37 nt, Artificial Sequence
  source: /note="Description of Artificial Sequence: Synthetic oligonucleotide"
gucucaauagcgaucggcgccgcuuaguagggucgac

SEQ ID NO: 1042 - RNA, 38 nt, Artificial Sequence
  source: /note="Description of Artificial Sequence: Synthetic oligonucleotide"
gguaacaauagcgaucggcgccgcuugguagugucgac

SEQ ID NO: 1043 - RNA, 37 nt, Artificial Sequence
  source: /note="Description of Artificial Sequence: Synthetic oligonucleotide"
aucucaauggccaucgucggggcuuuguaccggcgac

SEQ ID NO: 1044 - DNA, 2373 bp, Artificial Sequence
  source: /note="Description of Artificial Sequence: Synthetic polynucleotide"
  modified_base (2145)..(2178): a, c, t, g, unknown or other
taatacgactcactataggggaattgtgagcggataacaattcccctctagatttacactttatgcttccggctcgtatgtttctagagaattcaaataattttgtttaactttaagaaggagatttaaatatgaaaatcgaagaaggtaaaggtcaccatcaccatcaccacatgaaactgagtccggcactgcctccgaccggtgatgttctgatttatgaatatggtgcacgtgttgatggtgattgtctgcctgcagttggtgatcagattgcaaaagcacgtcgtctgtataatgatctggttgcagttattcgtggcatcgttgatgaaatgcgtggttttgttctgaaacatgcaggtagcgaagcgctggccctgcaggcacgcattgatggtctgagcgaagcatttgatgcagcacgtgcagcaaatgatgaagatcgtatgaaacaaattgccggtgaacgtcgtgcactgtgggcagaactgggtgaacaggttaaagcagttcgtaaagcacatcgtgcagaaatccaagaactgtttctgagccgtattggtaaaaaaagcacctgtgatacctatcagatgcgttgtaaagccgttggtgatggtttaggttgggcaaccgcaaatcaggttctggatgccgcactgcaggcctttaaaaccagctttcagcgtggtcaggcaccgcgttttgcacgtggtgaagaaaaaattcaggataccctgacactgcagtttaccgcagccggtggtgttccggttgcagcactgctgagcggtgatcattcagaactgagcatggttagcagctgtggtcgtcgtaaatatggtagctttagctttcgtctgggtagcgcaagcgcagatacctatgcaaatggcacctggcagtatcatcgtccgctgccggatggtgcaaccgttggtctggcacgtctggttcgtcgtagcgttggtaaagatttcaaatgggcactgcagctgatggttaaacgtccggcaaccgaaccggcaatgatggaaggtcgtaaaccgctggttgccgttcattttggttgggctggtgatgcaagcggtcgtcgtgttgcaggtattaccgatggtgcagatccgggtgttgcccgtgttctgcagctgccggttgaagttgaagatggtattcgtcgtgcagcagaatttcagagcgcacgtgatgaagcccgtgatgttattatgaccaccattaaaaacattgcatggggtgatgcagttgcatgtctgggtgaaagcagccagtttatgcatggtagtgaaccgtggctgcgtgcacgtctgagtgaagaactgagtaccattcgtcgtctgccagcacagcatgttgcaccgcgtcgcctgcatcgtctgtgtggtctgctgcgtgccaccaatcagatgcatgatgaactggaagcatggcgtaaacaggatcgtctggcatggcaggcaagcgcacatatggcacgtcgtgcccgtaatctgcgcaaagatttttatcgtcgtgtggcaattgatctggcacgccgttatagcgcaattgttctggaaccgctggatctggcagcagcagcactgaaagttaatgaaattacaggcgaaaaaaccgaatttgccaaaaaagcccgtagcggtcgtgttgtggcagcaatttatgagctggaaagcagcattcgttgggcagcagccaaaagcggcaccgcactgctggacctgagtggtgcagaaaccgcagcacgttgtggtatttgtggtggtgcaagccagagtgatgaaagcaatagccaggttctgcattgtgttgaatgtggtgccgaactggatcgcaaaaaaaacggtgcagcaattgcatggcagtttgcacatgaaaatctggatgaagcagttaccgatttttgggcagccgttattgcacagcgttgtgaacatgcagaaaaaacccgtgaaaaaaaagccaaaatggcagaaggtcgtcgcctggcacgtaccctgagtgccggtgttagcgcagttggtagccgtaatgtttaataagaattcctcgagttgacagctagctcagtcctaggtataatgctagcgtttcatcggccatcgcggcggcctcgtagctgcgacnnnnnnnnnnnnnnnnnnnnnnnnnnnnnnnnnngtttcatcggccatcgcggcggcctcgtagctgcgacgctaaagatatgaggagctcaaactcgagctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 1045 - DNA, 110 bp, Artificial Sequence
  source: /note="Description of Artificial Sequence: Synthetic polynucleotide"
agtttcatcggccatcgcggcggcctcgtagctgcgacaaaaaaaaaaaaaaaaaaaaaaaaaaaaaaaaaaagtttcatcggccatcgcggcggcctcgtagctgcgac

SEQ ID NO: 1046 - DNA, 54 bp, Artificial Sequence
  source: /note="Description of Artificial Sequence: Synthetic oligonucleotide"
tttcatcggccatcgcggcggcctcgtagctgcgacaaaaaaaaaaaaaaaaaa

SEQ ID NO: 1047 - DNA, 60 bp, Artificial Sequence
  source: /note="Description of Artificial Sequence: Synthetic oligonucleotide"
  modified_base (37)..(60): a, c, t, g, unknown or other
  misc_feature (37)..(60): /note="This region may encompass 16-24 nucleotides"
tttcatcggccatcgcggcggcctcgtagctgcgacnnnnnnnnnnnnnnnnnnnnnnnn

SEQ ID NO: 1048 - RNA, 54 nt, Artificial Sequence
  source: /note="Description of Artificial Sequence: Synthetic oligonucleotide"
  modified_base (37)..(54): a, c, u, g, unknown or other
uuucaucggccaucgcggcggccucguagcugcgacnnnnnnnnnnnnnnnnnn

SEQ ID NO: 1049 - DNA, 112 bp, Artificial Sequence
  source: /note="Description of Artificial Sequence: Synthetic polynucleotide"
tgtaacaacagccattaccctggcttagtaagggtgacaaaaaaaaaaaaaaaaaaaaaaaaaaaaaaaaaaagtaacaacagccattaccctggcttagtaagggtgacca

SEQ ID NO: 1050 - DNA, 52 bp, Artificial Sequence
  source: /note="Description of Artificial Sequence: Synthetic oligonucleotide"
acaacagccattaccctggcttagtaagggtgacaaaaaaaaaaaaaaaaaa

SEQ ID NO: 1051 - DNA, 58 bp, Artificial Sequence
  source: /note="Description of Artificial Sequence: Synthetic oligonucleotide"
  modified_base (35)..(58): a, c, t, g, unknown or other
  misc_feature (35)..(58): /note="This region may encompass 16-24 nucleotides"
acaacagccattaccctggcttagtaagggtgacnnnnnnnnnnnnnnnnnnnnnnnn

SEQ ID NO: 1052 - RNA, 52 nt, Artificial Sequence
  source: /note="Description of Artificial Sequence: Synthetic oligonucleotide"
  modified_base (35)..(52): a, c, u, g, unknown or other
acaacagccauuacccuggcuuaguaagggugacnnnnnnnnnnnnnnnnnn

SEQ ID NO: 1053 - DNA, 110 bp, Artificial Sequence
  source: /note="Description of Artificial Sequence: Synthetic polynucleotide"
aattccaaggcgatcacagccgcctagtagttgtgacaaaaaaaaaaaaaaaaaaaaaaaaaaaaaaaaaaaaattccaaggcgatcacagccgcctagtagttgtgaca

SEQ ID NO: 1054 - DNA, 53 bp, Artificial Sequence
  source: /note="Description of Artificial Sequence: Synthetic oligonucleotide"
ttccaaggcgatcacagccgcctagtagttgtgacaaaaaaaaaaaaaaaaaa

SEQ ID NO: 1055 - RNA, 53 nt, Artificial Sequence
  source: /note="Description of Artificial Sequence: Synthetic oligonucleotide"
  modified_base (36)..(53): a, c, u, g, unknown or other
uuccaaggcgaucacagccgccuaguaguugugacnnnnnnnnnnnnnnnnnn

SEQ ID NO: 1056 - DNA, 59 bp, Artificial Sequence
  source: /note="Description of Artificial Sequence: Synthetic oligonucleotide"
  modified_base (36)..(59): a, c, t, g, unknown or other
  misc_feature (36)..(59): /note="This region may encompass 16-24 nucleotides"
ttccaaggcgatcacagccgcctagtagttgtgacnnnnnnnnnnnnnnnnnnnnnnnn

What is claimed is:

1. An engineered, non-naturally occurring Clustered Regularly Interspaced Short Palindromic Repeat (CRISPR)—associated (Cas) system comprising:
   (a) an RNA guide or a nucleic acid encoding the RNA guide, wherein the RNA guide comprises a direct repeat sequence and a spacer sequence; and
   (b) a CRISPR-Cas effector protein or a nucleic acid encoding the CRISPR-Cas effector protein, wherein the CRISPR-Cas effector protein comprises the amino acid sequence set forth in SEQ ID NO: 127,
   wherein the CRISPR-Cas effector protein binds to the RNA guide, wherein the spacer sequence comprises a sequence complementary to a target nucleic acid, and wherein the spacer sequence binds to the target nucleic acid.

2. The system of claim 1, wherein the direct repeat sequence comprises 5'-YBVMRAC-3', wherein Y is C, T, or U; B is T, U, C, or G; V is G, C, or A; M is A or C; and R is A or G at the 3' terminal end.

3. The system of claim 1, wherein the direct repeat sequence comprises an RNA transcript of a nucleotide sequence set forth in SEQ ID NO: 325.

4. The system of claim 1, wherein the spacer sequence comprises between 15 and 24 nucleotides in length.

5. The system of claim 4, wherein the spacer sequence comprises between 16 and 22 nucleotides in length.

6. The system of claim 1, wherein the target nucleic acid and the spacer sequence comprise at least 94.5% sequence complementarity to each other.

7. The system of claim 1, wherein the CRISPR-Cas effector protein recognizes a protospacer adjacent motif (PAM) sequence, wherein the PAM sequence comprises a nucleotide sequence set forth as 5'-TTN-3' PAM or a 5'-YTN-3' PAM, wherein N is any nucleobase and Y is C or T.

8. The system of claim 1, wherein the CRISPR-Cas effector protein further comprises at least one nuclear localization signal (NLS) or at least one nuclear export signal (NES).

9. The system of claim 1, wherein the CRISPR-Cas effector protein further comprises an affinity tag, a fluorescent protein, a base editing domain, a DNA methylation domain, a histone residue modification domain, a localization factor, a transcription modification factor, a light-gated control factor, or a chemically inducible factor.

10. The system of claim 1, wherein the nucleic acid encoding the CRISPR-Cas effector protein is codon-optimized for expression in a cell.

11. The system of claim 1, wherein the nucleic acid encoding the CRISPR-Cas effector protein is a DNA molecule and is operably linked to a promoter.

12. The system of claim 1, wherein the nucleic acid encoding the CRISPR-Cas effector protein is in a vector.

13. The system of claim 12, wherein the vector comprises a retroviral vector, a lentiviral vector, a phage vector, an adenoviral vector, or an adeno-associated vector.

14. The system of claim 1, wherein the system is present in a delivery system comprising a nanoparticle, a liposome, or an exosome.

15. A cell comprising the system of claim 1.

16. The cell of claim 15, wherein the cell is a eukaryotic cell.

17. The cell of claim 15, wherein the cell is a mammalian cell or a plant cell.

18. The cell of claim 17, wherein the cell is a human cell.

19. A method of binding the system of claim 1 to the target nucleic acid in a cell comprising:
   (a) providing the system; and
   (b) delivering the system to the cell,
   wherein the cell comprises the target nucleic acid, wherein the CRISPR-Cas effector protein binds to the RNA guide, and wherein the spacer sequence binds to the target nucleic acid.

20. The method of claim 19, wherein the target nucleic acid is a single-stranded DNA or a double-stranded DNA.

21. The method of claim 19, wherein binding the system to the target nucleic acid results in cleavage of the target nucleic acid.

22. The method of claim 21, wherein cleavage of the target nucleic acid results in formation of an insertion or a deletion in the target nucleic acid.

* * * * *